United States Patent 12,144,310 (TOBACCO PLANT RESISTANT TO SPOTTED WILT DISEASE WITHOUT LINKAGE DRAG AND METHOD FOR BREEDING THE SAME) - sequence listing, part 2

SEQ ID NO: 34 - DNA, 3176886 bp, Nicotiana alata (residues 1,588,444-3,176,886 of 3,176,886)
  misc_feature (210057)..(210182): n is a, c, g, or t
  misc_feature (455653)..(455755): n is a, c, g, or t
  misc_feature (472640)..(472864): n is a, c, g, or t
  misc_feature (525206)..(526010): n is a, c, g, or t
  misc_feature (533227)..(533750): n is a, c, g, or t
  misc_feature (564531)..(564692): n is a, c, g, or t
  misc_feature (724654)..(724663): n is a, c, g, or t
  misc_feature (960902)..(961018): n is a, c, g, or t
  misc_feature (1036758)..(1036969): n is a, c, g, or t
  misc_feature (1168263)..(1169262): n is a, c, g, or t
  misc_feature (1189364)..(1190363): n is a, c, g, or t
  misc_feature (1195442)..(1195642): n is a, c, g, or t
  misc_feature (1197417)..(1198416): n is a, c, g, or t
  misc_feature (1210991)..(1212052): n is a, c, g, or t
  misc_feature (1237147)..(1237556): n is a, c, g, or t
  misc_feature (1374726)..(1374826): n is a, c, g, or t
  misc_feature (1374961)..(1374972): n is a, c, g, or t
  misc_feature (1500628)..(1500670): n is a, c, g, or t
  misc_feature (1533707)..(1536130): n is a, c, g, or t
  misc_feature (1587173)..(1590149): n is a, c, g, or t
  misc_feature (1683927)..(1684221): n is a, c, g, or t
  misc_feature (1754760)..(1754783): n is a, c, g, or t
  misc_feature (1779656)..(1779792): n is a, c, g, or t
  misc_feature (1815052)..(1815421): n is a, c, g, or t
  misc_feature (1825786)..(1825795): n is a, c, g, or t
  misc_feature (1829191)..(1829282): n is a, c, g, or t
  misc_feature (1829606)..(1829975): n is a, c, g, or t
  misc_feature (1933202)..(1933329): n is a, c, g, or t
  misc_feature (1935145)..(1935269): n is a, c, g, or t
  misc_feature (2008989)..(2009248): n is a, c, g, or t
  misc_feature (2099577)..(2099586): n is a, c, g, or t
  misc_feature (2143289)..(2143358): n is a, c, g, or t
  misc_feature (2177389)..(2177733): n is a, c, g, or t
  misc_feature (2365752)..(2366282): n is a, c, g, or t
  misc_feature (2494224)..(2494623): n is a, c, g, or t
  misc_feature (2526823)..(2526954): n is a, c, g, or t
  misc_feature (2597021)..(2598223): n is a, c, g, or t
  misc_feature (2676240)..(2676920): n is a, c, g, or t
  misc_feature (2697482)..(2697491): n is a, c, g, or t
  misc_feature (2772481)..(2772687): n is a, c, g, or t
  misc_feature (2819730)..(2819739): n is a, c, g, or t
  misc_feature (2819916)..(2822253): n is a, c, g, or t
  misc_feature (2833092)..(2833906): n is a, c, g, or t
  misc_feature (2869119)..(2869128): n is a, c, g, or t
  misc_feature (2931138)..(2931150): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatcacagtacgcgtatcatacgccaatttactatagaatctcactcgggatggaccaagtcacaatccccaacaacatccgactccgcacttatccaggagtgcgagtcacgcctcaacatagcgttacgatgtgaaagtccagggtttcaaaccctcagaacaacatttactagcattactcacctcgaaccggcgaaatctcaagcccgcgacgcctttgcctctcaaatcggccttctcgcgcgtcgaatctaagcaaaaacagagcgaatacatcacaataggcaaatgggacaatagccaatcgaaaacaaccgataaatagccaaaatctcgaaactagcaaaacccgagccccgggcccgcttctcgaaaaattacgaaacttacattttcggaatcctcatctcgccacgagtccgtacatatcaagttcatcaaaatcggagtccaattgctcctccaaatcctcaatcttcatttgaagttccaagccctagttcttccccaatttgatttgatttcagaaatttaagggctaaatccatgattaaatgatgttttgaattcataaaactcacctccgatcaatcctcttcgaatccctcttcaatttgcaccaaagagctctcaaggtcttcaaaaatggaggaaatataatgaagctcgcggatgaaataacccattaaaagacactgcccagctcgaccttcctctatgcgatcgcgaccggcctcctgcgatcgcatagagcaaccttccaggcctccccctcttggcctatgcgaacgcacactactccatgcgatcgcataactccgctgcccagaactacgcgaccgcgtccatacctctgcgatcgcagagggccactaactcaacctatgcgatcgcatcacccatgccgcgatcgcattgaacaaaacttaagcccccagcccagcgttctatgcgatcgcaatgccagacctgcgatcgcatagagcaaacgtctgcaacacctgaagctcaaaaatctgctgcacctttcaactttgaaattgtccgacaaccatccgaaatcaccccgaggcccccgggacctcaaccaaaagcaccaacatgacttgttacttcattcaaactttctcggatcataaaaacgctatctttaacatcgaaattcaccaaaatccttgaattcaattcaagattaaacttagacttttcaatatcacatccgatgccgaaaccaaccaaacgaggtccgaatgacctgaaaatttgcagacacatccaaaatcacctaacggagctaatgcaactttcggaattccattccgacccttggatcaaattctcacctatcaaccggatttctccgaaaatccaacttcgccaaaataggctaactttcacaccggaactccgaattcacttccgctttcgccactaagtcacaaatcaacccccgaaactagtcgagccatcggaaatccgttccgagccctctaacccataagtcaacgttgggttgacttttccaacttaagcttttcttaaagagactatttgtctcatttccatccaattgccgcccaaaccacttaaaacttaccaaacacgcatatcaacacacggggaaacatataacagggataacgggccggaggtacgagagacgacgggtcgggtcattacatcctccccaacttaaacaaacgctcgtcctcaagcgtaccagagatgtactagaagcaacccaataatcaaatgacattaccagacatgtgcccggggtgatcccacgtcaccctaactcacataggcgccgataacaaaacacagccgaaatttcacaatccatctggcccataaactgcagaatcacattgcatattccgaaatcatacacaagatcagaatctcacatccatactcggaattagcccgaaccagctgtaacaacccacacctgcaaccttagataaattcgtacaatataccacacatctcaacactcggaacgaatagtctctattcacggcaattgcccacaatactcaattcccagtaggaaaacctcttatttagctaaagccttattccaacactatcatatactaccgatgataactaaaacacgcaatgaactgtagcagttctttagatcaaccattcatgaagtcacttccaagttgactattaccacaacggattttcgggtcaaaccacgatattatcctcctaaccagctgaaatcaaatccgctcactttcataataacccaatgatcaccttgaatctgacacaccactgctggtgatatgatgcctcgatacaagcctaagccacaatttgcataatacatgcgccaaaggaaacagtctacacatacccaaatcgggcgaatgacacaaccggaagagttatacctcaaactcatcgataccttcacaaaacaaagcagggaccccgtcccatatcatagaaataaagtatctgaatcctcctcgagaggtcataacttcacgtggccttgccacagcgcgcgatcctatcccaacactgatacacatgaaacacctcgtgctaccatgctcaaagccgacaaccatgcacatatcaatgcctaaaatcaagtaacccatcactctcacggtgaaacaagtaatatacaccattccgtcctgaaaggacacaaccgaaatgctattcgccagcaattttcaatacggacttccctcggaagccaggaagcaaagaatacacatcaccacatggaaaactgttctcaacatcacactgttgcggcgcgcaacccgatccagataacatacccgtggcggagtgccacccgatctacacaaccacctcacacagggaggtgcacatcgagccaaatttgctcacaataacaaaatatccacatcggtcgaagcaactgagtgcataaagatatacataaaagcattgcaagctacaagatttcactttcactactataactcttgacgagccgaacgatatggtgcccgacaccaaataattaccgaaattcacagtctcgcccggcgacatgcccggccacaaggacgcatctggaaagtccctcaataccggaaccgcaatcaatgatagaaacctctatactgacattcgcctcgaagacccaattaaggaacgcaattcttcccagctatccgctagactctggaacacaaccattcagctagaacatagtccgacacacctcgccacgcaacctgtggcatttcccaacatgactcatagcacaatcgggtcgaataatccaacactgaggcaatcactttacatccccataccatatccagaatttaaggtattaagcaaggaaaaatccatccggattccaaccttccaatagccgctgacagcaccgatacaacacacgcgatccataaccgctacatagactgcaccggagaattcccagtctccaactaaccatagcacgcgaatcactgcacctgatccaaatttccaccatgcgaaatacaaatcacacctcaagtacccaactatcccacgaggtatatttttaaaactcccatgtgccatcaaacaactcagatatccgcagtcttccataagaaaatgccgtaacactactgatgtatcatttgcgagattaccctctttccgaaacatatgccatcgtcaaatcacttccaattaacagcaccatttttttttttgactacctgaagctactcgtcacttaagtcttaaccaacctgccatacctttcagaactgaactgagaccttgcactatgcccatctcaggcctttacaacaaaccgcatataccgtatcctcctaggataacacaagacctttcatctcctttctgcgccgcagacgtcgacgcactcaactagtctagatctttcattgatctcatttagaaggaaaatcattacacatctcatgccaactcacattcatagaaaatgcacctcttcaaccctgtatggatcaacaagaactctcccaatcctgtctgcacaactaaaccgccatgactgaatcccttttaattacgacacacagagataatcgtcaacatccaagagcattgctgcaaaaatttcccgtgctaaaccattaccccaaatacaccacgagaaccaatcctatccttaccataccgattcggtcccccaacaagttacttatttgcctagattcccatctggttccttttcaacttgatacaccctcttgccgtagcaccacaatgcctcaacccaggcttctaaacaagacccgaacaccaacccacactgtctaagacccttaggccactgaatactttctcaacgttctcgggactaccacattccagagtactttaccccaagaacttcctgcgactctgatttagttgccaattcatcccgaataccgatacttagaatctcgcaattaacataaaaataccataagtcttgacctgttccaatgaaaacactgactagatcgcatgcccaaccttagaacacccgagtgatacatatagattcttgaacacatcgaaacccttctcaaaagtcatccactcttatgcctactgcaaattacttgacttaacaaatcgaacccctcgtgccttatcgacaccctgacaccacaggacatgatctctttccgatacaaccgaacaactttccttttctttacgctaagcattctctctatcaataactcaagacattccctcattttctcacacccacgaagtaccatataatccttggccaaattttgcttcactcgagccaccctcggctcactctctgcagctagaactgattaacacacatgcatcaaatcggaaccaattatagtacataaccgtacagtcagctaatcaacagcaacctccccaacttagcttgaagccatatatattaaaacacacatactctatagccatcataacatcatggcgagattaaactcactcttccataagcttgtggaaacacgaatcatcagaaattccaacctttcttcaactttttgcattcattcacaccaccgttaagcccactccttaggcgacaaaattcctaccaagtcccaaatttttccgaaaatttcggcagagtttcctttgtaattgagcctatccacctgccagagaatcaccaaaccatcctaacaacacgtccataacttgacaagacattacaatgtacatcaaccacattaatctcaatactacatgtattatattatcaaaattgacacatgaacacgcgttgcacctgatcgaatcataacatatggaaaatacctttttattacacttaagatcttctaacatacacataatggtcataccacttcagaagaatccgcagaagctaacccacctgcttgtttcaatataatattttggtacatcatccaccgccatacacctcacgcaatcaattggtcttcctgagtctggcctcataccaccacacgcacactcccaagtaatacaagcacatcacacagcaccaacgcaatcatcatgaagctattcagccgccattaccgcaatttagggactataccgaactcatgagctcataacactagctcgcgcaatcagcaccttggtgctcaagctatagacacagattcggcctcaagtcctccagaatggcccaacatcaactcatagaaatcatcactcgcccctcgatcggggaaatcatcagccatcaaggcacatatagcactgggcgctcacgggcgcatacaaacgtgaagaaggaatttttcaaaagttatatccccagctgaatcaaatacgcacgataagaattccaagaatgtgaggtgttttcctacagttctgtagcctctcgtggatatgatacggacgtctacgcaccgatccacaagactctactaaaccggctcatgactcgcgagaccaagtaacctaggctctgataccaagttgtcacgaccccaaacccggtcgcgatggcgcccggccgtaaggctaggcaagcccgaccacaatctagttgtcacgaccccaaactagttgtcacgaccccaaacccggtcgcgatggcgcccggccgtaaggctaggcaagcccgaccacaatctcaataatcccagataaagacaataaagaaataatagtctcaacacgaaagagatttatatcccaaaagacagagcggaatgaactgaaaccaatagcaaatcccataggaacaggtgtcacaagtctgagcctctagaataacaactcaatctgatacaaatctggtggtaactgaaagtacacaggaaaaacaggaaataaagatagagggaaggagggtcgatggctgcgaacgccgtgcagctacctcaacgctccgaactgttgatgtctgaaaagctgcaggacctaatccgcctgagcatgccctggatctgcacacaaggtgcagggagtaatgtgagtactccgacccagtgagtaataataataaatgaagctccgaagataagaaaacacagtaaatgcacaaagtaagctaaataacagaaaaccacaatatcagaacaactgaacaataagtaagataaggtgcaaatgcagggatgctatgcaatgcaaatgttggtacaatccagtacccactgcggcgtgcagtccgagccaaccatatcatttatcgtcgacggcgctcactgggggtgtatacagactccggaggggctcctacagcccaagcgcaataatcagccatctcgtggtggcaaaatcaataacccggtcagtccatgttacctgaccgctcatacgacacagtgtccatgttaccactggtccaatcaccgctgtggcgtgcagcccgagccaaccaatatcagtccagaaaatatatcacaagccacttgggcagttataagtcatgatcctcagccgaaatacatttgaaaagatatcatgtgagtttgaacatttgaaatacggctgggttttgaaaccaatgctttaaaaagccatggactgatatgaatgatatgcaatcatgataaacagtaatatccactctcgaagagtatcacaggtcggcactaggccccaaacacggcatatagcccaataataacaatcacagtacgcgtatcatacgccaatttactatagaatctcactcgggatggaccaagtcacaatccccaacaacattcgactccgcacttatccaggagtgcgagtcacgcctcaacatagcgttacgatgtgaaagtccggggtttcaaaccctcataaaaacatttactagcattactcacctcgaaccggcgaaatctcaagcccgcgacgcctttgcctctcaaatcggcctcctcgcacgtcgaatctaagcaaaaaaagagcgaatacatcacaataggcaaatgggacaatacccaatcgaaaacaaccgataaatagccaaaatctcgaaactagcaaaacccgagcctcgggctcgcttctcgaaaaattacgaaacttacattttcggaatcctcgtctcgccacgagtccgtacatatcaagttcatcaaaatcggagtccaattgctcctccaaatcctcaatcttcatttgaagttccaagccctagttcttccccaatttgatttgatttcagaaatttaagggctaaatccatgatttaatgatgttttgaattcataaaactcacctccgatcaatcctcttcgaatccctcttcaatttgcaccaaagagctctcaaggtcttcaaaaatggaggaaatataatgaagctcgcggatgaaataacccattaaaagacactgcccagctcgaccttcctctatgcgatcgcgaccggcctcctgcgatcacatagagcaaccttccaggcctccccctcttggcctatgcgaacgcacactactccatgcgatcgcataactccgctgcccagaactacgcgaccgcgtccatacctctgcgatcgcagagggccactaactcaacctatgcgatcgcatcacccatgccgcgatcgcattgaacaaaacttaagcccccagcccagccttctatgcgatcgcaatgccagacctgcgatcgcatagagcaaacgtctgcaacacctgaagctcaaaaatctgctgcacctttcaactttgaaattgtccgacaaccatccgaaatcaccccgaggcccccgggacctcaaccaaaagcaccaacatgacttgttacttcattcaaacttgctcggatcataaaaacgctatctttaacatcgaaattcaccaaaatccttgaattcaattcaagattaaacttagacttttcaatatcacattcgatgccgaaaccaaacaaacgtggtccgaatgacctgaaaatttgcagacacatccaaaatcacctaacggagctaatgcaactttcggaattccattccgacccttggatcaaattctcacctatcaaccggatttctccgaaaatccaacttcgccaaaataggctaactttcacaccggaactccgaattcacttccgctttcgccattaagtcacaaatcaacccccgaaactagtcgagccatcggaaatccgttccgagccctctaacccataagtcaatgttgggttgacttttccaacttaagcttttcttaaagagactatttgtctcatttccatccaattgccgcccaaaccacttcaaacttaccaaacacgcatatcaacacacggggaaacatataacagggataacgggccggaggtatgagagacgacgggtcgggtcattacatctgcaagtgttgcaatatatactaaacagttagaaatagtaggataatattgcccagataattcatttgtagtaacatgaaattgttctaataagtctacaaaatttttaacattagtccaatcctgatttgtaaggtgctcatcatcatcatcatcatcatcatcatcaccaccgacatgagcattaaactttgcatttattgggtttcaatattcatatgcaataactaaactttcatacatataattccatctattcggacattttttaaaatattctcaaagtctacttctacggtttgaataaaaaagccaattaagagccattttagccttttcaatttcaacatttaatactttcataccatcatcgacgattaagcagtaaatatgacaaatatatctaacacggaaaatattactaaatgcaggatttagtgtagttgtaagcaagcctataggtggaggaggacgggtaacacgtctgggtcggggagccgggagaggaggaggaggggtacatgcaattccatctagtcagacattttttaaaatattctctaagtctacttctacggtttgaataaaaaagccaaataagagccattttaacctttttaatttcaacatttaatattttcataccatcatcgacgattaaatggtaaatacgacaaatacatctaacatgaaaaatattactaaatgcaggatttagtgtagttgtaagcaagcctataggtggaggaggacgggtaacacgtctgggtcggggagccgggggaggaggagtagtagcttggccactagattcaccaattttagattttcccttaccaccaaatatttttttcaaagaaaaggccatattaattataattatacaaactaaaacaaacaaaactataatattaaaacttaagagttggaacgagtttaccgaattgacgaacaacttcttgaaaattgtatatcattgaagacttgaatacttcaattcaccaacttcacaatttttcacaaattgcaataataaagtaagtaattatagaagaaaattagagagagattgataattttgtgagtaaaaatgaaagaatgagggggtatttatagttgagaataggaaaaaagtataattataaaaggtttggggttaaaataaagtttggggggcaaatgactattttttaaaaagccaaacggctgaattggtaggccaacggctagtttttaaacttccaactgttggccatttttttaatttttcttttgaaaaatagccgttgggtctgttaggcccagttgaaccagcccaggcccgccagccagtcccgggcttgcggcctctccttgctagaccggcccatagtgggctcctaggaccgcttgggaccggaccatatgggccagcccatttagcctaaagcccatgtgggctcgcggtcccgggatgggcctattcctcaatgatacacaattttcttggatccttggcagcctcattctggtttggaaaaattgtagccatttgaaaacctttttaaatacactaactccttgtatattggttatactttctcccaatggtggagctatacataggctcaagggacgtcggttaaacacctttcgcttgaaagttaatattatgtatataggtcaaatattactttgtatacattaatattgaatgttgaacattcttaatgaaattgctcgctttgtcattgcttgctcttatctctgcattgtcatttctctcccttgtttttttgaccctactagcggagatagatttgagtctttaaaagagcattttaacaatacttattattttaggggggggggtttaattttacctttcgttatgctttggatctatgtagttcaattggttagagaaaatgactgaaaatctttgtgtcagttgttcgaattcacttctaagtaggcaaaagagccaaactgaagtggggagcgagtcagatgtagaaatgaaagtggatgaataagcaaaaaaaaaaaggtaagtgttcctattatacatgaggttttttggcggtagggttgagttggattgcttgaggtagattcaaaaaaagaaaaaacggcaattgatcattactcgattagttcttcttattccaaccactagtataacaacccgcgttgtgacaacccaaagggtcatcaccgtaattcttccttgttccgtgcttccgagaccttgaaaacctcgcgtttagttgcctcaatttacgtgcgtagtccgagcgcgaagccgaaaagtttttatgttgaaatatgtgaactatgtgttaaaattgaagaattttgatattaatattgttaaagttgacttcggtcaacattttgggtaaacggacccagacccggacccgtgatgtgacggtcccggagggtccgtaggaaaatatgagactcgggcatattcccggaatcaaaatccgaggtctcaagcccgagaaatgaatttttgaaagaaattgtttatctgaaaaagatatggaattttgaaaagaaaatgagttagaaaatataggtatcgggctcgtattttggttccgacgtccgatacaggtcttaaatatgcgttaagcgctttctgtgaaatttggtcgaaatcggacgtcgtttgacgtgtttcggacctaaatatctaaagttagaggtttatgaactttaaaatgaaaaatgatgattttggggtttgattcattgaatttgatattattttggcgatttgatcgctcgactaagttcgtaggatgtatttgagttagtgtgtgtgtttggttgggagccccgagggctcgggagtgatttcgggggtggttcgggtgtttttggacttagaacacaccagattttccagccttgttgcagaccagttgttacccttcgcgaacgcggcccctggctcgcgttcgcatagcctagatttttctcccttcgcgttcgcactcctccactcgcgttcgcgtagttcagacttccccttcaccgcgttcgcgagtcccttatcgcgttcgcgtacaagccagcctagacccccagtttttcttcttacgcattcacactgcccaatcgcgaacgcgatgttttccgcccagttctcttcgcgaatgcgacctacacgtcgcgaacgcatagagtattttgcttcagtgattatttaaaaacagaacatttcaactacgagtttagaccatttttcacacgaaccctcttctcccccaagctctaggactccattgaagcctcccttcttcaagacttcttgggtaagtaatttcccacctatttcctccacttttcttcattaattagtgaattcctaggcctaaaatgtgaaatcaaagtagaaattagggcttttgggtagagtttagttttttggaattttgggcgattcaaccccaatttggggtcgaatcttaaaataaactgcatatttgaactcgtggggttatgggtaattgaattttggtccgaacctcgagtttggaccatgtgggcctggggtcggattttggtatttttggaagaatgataagaaattcatttctaggctatggaattgtgtctttgagccattattgataatatagaactaaattgtgcctagatatcattgtttcggagttggattctagaggaaaggcggtgctagagaattgattgctatattcggaccgaggtaagtgtttgatctaactttggcttgagggaataggattaggatattatttgctatgtgctaattgtggagtacggtgtataggcatggtgacggttatctatgcaccggagtctagcatgaccgtgagtcttaattgcttttaattcgaatgatatgatacggcttcttgtttgaattaatttagttcacatgatatgaacggttgaggataaatagtgatttataatatttggagcgttggctcggacaagaatgtgttagttgtgaaagagataatctaaaagagaatgtgttggaattattcccttgccgggatattttgagctgtttgttgtacccttgttgggacttatctgttgttttgtttcccttgccgggacgtataatactgttttgtttatttccctcaccctgattggttgtgactgttgatttggtgaggaagagtgattgtgcacgaagggtcattccgtgccacgttttgatatttacgcacgaagggtcattccgtgccatggtttgaataatcatgcacgaagggtcattccgtaccttgatatgagagtatgtgaggaaaagcacgaaggttgatgccgtgcactttatttgactgtttttggtgagaacaagagtaaaagcacgaaggttagtgccgtgcggttgttgatttacctgttctccttagttgatgctattgttcagttccatttcattattcgttaatcctatatctgaattgttacatccccatagtatgctcccctccctcttagctgtttaaattctgtatattcttgcaattatatatatatatatatatatatatatatatatatatatatatatatatatatatatatatatatatatatatatatatatatatatatatatatatatatatatatatatatatatatatatatatctgcacaggttgtttttggtaggtcctgtctagcctcgtcactacttcgccggggttaggccaggcacttaccagcacatggggtcggttgtgctgatgctacactctgtgcatttttgtgcacagatcagggagcagcttacgaaccacagcagtagtagatcgggagcagaccttcagtccagagacttcgaggtagcattgctgacgtccgcaggcccggagcctcttctatctttattcagtttgttagcttttgtactgaaacagactgttatgctatctttcagatgattgtatttagtaaatcttagaagttcgtgagtattgtgacaccaatcttgggtagaggattttgttaaactttctgcatttctttcagttaattgtaatcgagacttccgcttatttcattgcttcgtactaattatattatcgaaaatgttagttaaaatgtttgagtgtcggcttgcctagctcctaatagtaggcaccatcacgactcccgatggtaggaaatccgggtcgtgaccagttggtatcaaagcactaggttacttgggtctcccaactcacggacaaactcggtagagtctgagggatcggtacggagacgtctgtattatcccctagaggctacagagttaggaaaatctcactttgttcattcttgtcgtgcgattctgtttctcaagtactgattgtctttctactttggttctttcgtagatggcgagaacacgtgcttcctcttctaccgcgcagcagcctgagcccccagcagtagcatctattaggggcagagggcgaggccgtgccagaggccgaggtcggggcagagctcagccctgagcagcagtcccagaggtggagcctcatgttgactacgatgaggaggttccagctccagcagctccagtgggcccagctcaggtcccagagggttttatagccactccagtgcttcaggacgctttggtccgactggtaggattcatggagggcatttctagagcgggtttgcttcccgtagctccagccacatctcaggctgggggaggagttcagactcccactactcatactccagagccggtaactcctcaggctcaggttccaacagtttagccagctgtggtagttcacccagctgtggcagctcaaccagttgcggctcagtccagcgatggtgcggctatgtccgcggatgctttgtggaggcttgatcgtttcaccaggctctttactctcacatatagtggtaccccttcagaggatgctcagaacttcatattcagctgtcatgaggtttttcggaccatgggtattttggagaccaatggggtcgatttcgctacttttcgcctagcaggatccgccaagacttggtggagagacttctgtttagccaggccagcagggtcgccatcattgacctgggatcagttttcagagctatttctggggaagtttctcccagtcactcagcgggatgctctccgcaggcagtttgagcgtctccagcagggtactatgaccgtcacccagtacgagacccggttcattgatcttgctcgccatgctactgtgatactccccaccgacagcgagagggtgcggaggtttattgatgggttggctcagccgatccgtttttagatggctatgggtgccggtagtgagatatcatttcaggaggcggcagatggtgcccaccggatagagatggcacttgctcagggaggtggtcatgggtctgataagaggccccgccattctggtagattcagtggtacctcgtctggaggtagggattcctatggtagaggccatcctccgaggccctttcagtaagctcttcaggcctctcatggtactccaggcagcagtggttctcggccgtactattctaagcagcagtctttcggtgcaccaccatctcctttcagtgcaccaccccttaagagcttcaggggaggacattcaggtcgacaggtccagcagcctcagcagccgagggtttgtcatggttgtggtgacccgagtcacattgttagattttgtcctcatgcttcgggaaattcgcagcagcagggtcctcgtcctaggatacaggcactagttgccccacagcctgcccagccaactagaggcgggggtagagggcatagaggtggaggcagaggtcttagaggtggagctcagaccgccagaggtaggggtcagtcagcagcggattatcccagggatgtgattcaggaaggtggggcccagccccgttgttatgctttgccagccaggccagaggctgagtcatcagatgctgtgattacaggtactattcaggtttgtgatagggatgcttctatgctatttgatcctggatctacgtattcatatgtgtcgtcctattttgcaccctatttggttatgcctagtgaggccttgagtattcttgtatatgtgtctacaccagtgggtgattctatagtggtggatcgggttcatcattcctgtgttgtgatattcaggggtcttgagacccgtgttgacttgttgctcttggatatggtggacttcgacgtcatattagggatggattggttgtccccgtatcatgcgatcttggattgccatgccaagaccgtgaccttggcgttgctagattttccccgactagagtggagagggaccccaggtcacaccactcgcagcgttatctcatatgtgaaggctcgacgcatggtcgagaaggggtgtctagcttatctggcttacgttcgcgactccagcgctgaggtcccgtctattgattctgttcctattgttcgggagttccccgaggttttcccttcagacctgccgggtatgccgcccgacagggatatcgatttttcattgatctggcgccgggcactcagcccatttccattctgccatatcgcatggccccgccagagttgaaagagttaaaggatcagcttcaggatttgcttgagaagggttttattagacccagtgttttgccttggggcacaccaatgttatttgtgaagaagaaggatggttcgatgaggatgtgcattgattaccggcaattgaacaaggtaacaattaagaacaagtatccattaacgaggatcgacgatttattcgaccagcttcagggtgcgaaggtgttttcaaagatagatttgagatctggctatcatcaactgaggattagggcgtctgatgtccctaagacagcatttcgcactcggtatgggcattatgagtttttgatcatgtcgtttgggttgactaatgccccaacagtgttcatggagttgatgaaccgagtgttcagaccttatttggacttgttcgtgatagtattcattgacgatattcttatatattcccgcagtcaggaggagcacgagcagcacctcagagtggttcttcagactctgaaggatagttagttatatgccaagttctcaaagtgcgagttttggttgagttcagttgcatttctgggtcacgtcgtttcagtagagggtattcaggtggacccgaagaagatagaggcagtcaagaactggcctcgaccagcttcagctacagagatccggagtttcttgggtttagcaggttactacagacggttcgtggaggggttttcgtccattgcagccccgatgaccaggttgacccagaagggtgcccagttcaggtggtcggacgagtgcgagacgagctttcagaagctcaagacagctctgactacggcaccggttttggttttgcccacaggttcagggctttatacagtttattgtgatgcttcccgtattgggcttggtgcagtattgatgcaggatggcaaagtcattgcctatgcttcgaggcagttgaaaatccacgagaagaattatccggtccatgatcttgagttggcagccattgttcatgccttgaagatttggaggcattacctgtatggtgtgacgtgtgaggtttacactgatcacaagagtcttcagtatctgttcaagtagaaagagttgaatttgaggcagaggaggtggttagagttgctgaaggattatgatgttactatcttatatcacccgggaaaggccaatgtagtggccaatgcattgagtaggaagtttgccagcatgggtagtcttgcttatattccagtcagccagagatcgctcactttggatgttcaggccttggccaatcgtcttgtgaggttggatatttcggagcctagcagggtgttagcttgcacggttgcgcgatcttcattgttggagcgtattcgtgagcgacagtttaaggatccccatttatgtgtcctgagagatacggtgcagcgtggaggtgccaagaaagtgaatttgggagatgatggtgtattgagattgcaggggcgagtttgtgtgcccaatgtcgatggtattcgggagttgatcttagcggaggcccatagttctcggtattctattcactcgggcgccgcgaagatgtatcaggatctgaggcagcactattggtggcataggatgaagaaggatatagtaggatatgtggctcgatgtttgaactgtcagcaggttaagtacgagcatcagaggctcggtggttcatttcagaggattgagcttcccgagtggaagtgggagcggattaccatggatttcgttactggccttccgatgactcggaagaagtttgattcggtttgggttattgttgataggctgaccaagtcagcgcatttcattcctgttgcaaccacctattcgtccgggagattagctgagatttatatcagagagatcgttcgccttcatggggtgcctatatctatcatttcgaatcgaggtccgcagtttacctcacacttctggagggcggttcaacaagagttgggcacccaggttcagttgagtacatcattttatccccagatggacggtcattccgagaggactattcaaattcttgaggatatgctccgagcctgtgtcattgattttgaaggctcgtgggaccagtttttgccgctagcagagtttgcctacaacaatagctaccagtccagcattcagatggctccgtatgaggcgctgtatggtagacagtgtcggtctccagtcggatggtttgagccgggagaggctcggttgttgggtacggatttggttcaggaggccttggataaggtccggattattcaggataggcttcgtacagctcagtccaggcagaaaagttatgcagaccgcaaggtcagagatgttgctttcatggtttgtgagcgagtattgctccgtgtatcgcctatgaagggtgtgatgagattcgggaagaagggcaagcttagccctagattcatcggtccatttgagattcttgatcgcgtgggagaggtggcttatagacttgccttgccgcctagcttgtcagttgtgcatccagtgtttcatgtatttatgctccagaagtatcacggcgatccatcgcacgtgttagatttcagcactgtccaattggacaaggatctgtcatatgaggaggagccggtggctattttggaccggcaggttcgatagttgaggtcgaagagttttccttcagtgcatttttagtggagaggtcagcctcctaaggcatcgacctgggagtccgagtctgatatgcggagccgttatcctcatctatttcccgactcaggtacttctttcttttgtccgttcgaggacgaactgttgttttagaggtggagaatgtgacgacccaaagggtcatcaccgtaattcttccttgttccgtgcttctgaggccttaaaaacctcgcgtttagttgccttgatttgcgtgcgcagtccgggcgcgaagtcggaaagtttttatgttgaaatatgtgaactatgtgttaaaattaaagaattttgatattaatattgttaaaattgacttcggtcaacattttgggtaaacggacccggacccgtgatgtgacggtcccggaggatccgtaggaaaatatgggactcggccgtattcccggaatcgaaatccgaggtcccaagcccgagaaataaatttttgaaagaaattgtttttctgaaaaagatatagaattttgaaaagaaaatgagttagaaaatataggtatcgagctcgtattttggttccgacgcccgatacaggtcgtaaatatgcgttaagcgctttctgtgaaatttggtcgaaatcggatgtcgtttgacatgtttcaggcctaaatatctaaagttagaggtttatgaactttgaaatgaaaaatgaagattttggggtttgattcattgaatttgatgtaattttggtgatttgatcgctcgactaagttcgtaggatgtatttgagttagtgtgtgtgtttggttgggagccccaagggctcgggagtgatttcgggggcgtttcgggtgttttggacttagaacacaccagattttccagcctagttgcagaccagcttttaccctttgcgaacgccgcccctggctcgcgttcgcatagcccagatttttctcccttcgcgttcgcactcccccactcgcgttcgcgtagtttagacttccccttcaccacgttcgcgagtcccttatcgcgttcgcgtacaagccagcccaggcccccagtttttcctcttacgcgttcgcactgcccaatcgcgaacgcgatgctttccgcccagttctcttcgcgaacgcgacctacacgtcgcgaacgcatagagtatttcgcttcagtgattattttaaaaacagaacatttcaactacgggtttagaccatttttcacacgaaccctcttctcccccaagctctaggactccattgaagcctcccttcttcaagacctcttgggtaagtaattttccacctatttcctccacttttcttcattaattagtgaattcctaggcctaaaatgtgaaatcaaagtagaaattagggcttttgggtagagtttagtttttggggattttgggcgattcaaccccaatttggggtcgaatcttaaaataaattgcatatttgaagttttgaactcgtggggttatgggtgattggattttggtccgaacctcgagtttggaccatgtgggcccggggtcggattttgatatttttggaagaatgataggaaattcatttctaggctatggaattgtgtctttgagccattattaataatattgaactaaattgtgcctagatatcattgtttcggagttgaattctagaggaaaggcggtgttagagatttgattgctcttttcggaccgaggtaagtgtttgatctaactttggcttgagggaataggattagggtattatttgctatgtcctaattatagagtacggtgtataggcatggtgatggttatctatacaccggagtctagcatgaccgtgagtcttaattgcttttaattcaaatgatatgatacgacttcttgtttgaattgatttagttcacatgatatgaacggttgaggataaatagtgatttgtaatatttggagtgttggctcggacaagaatgtgttagttgtgaaagagatgatctaaaagagaatgtgttggaattattcccttgccgggatattttgagctgttagttgtacccttgctgggacttatctattgttttgttttcccttgccgggacgtataatactgttttgtttattcccctcatcctgattggttgtgactgttgatttggtgaggaagagtgattatgcacgaagggtcattctgtgccacgttttgatatttacgcacgaagggtcattccgtgccatgttttgaataatcatgtacgaaggatcatttcgtgccttgatatgagagtatgtgaggaaaagcacgaaggttgatgtcgtgcactttatttgactgttttttgtgagaacaagagtaaaaccacgaaggttagtgccgtgcggttgttgatttacctgttctccttagttgatgctattgttcagttccatttcattattcgttaatcctatatctgaattgttacacccccatagtatgctcccctccctcttagctgtttaaattatgtatattcttgccattgtatatatatatatatatatctgcacaggttatttttggtaggtcctgtctagcctcgtcactacttcgccggagttaggccaggcacttaccagcacatgtggtcggttgtgctgatgctacactctgtgcatttttgtgcacagatcagggagcagcttacggaccgcagcagtagtagatcgggagcagaccttcagtccagagacttctaggtagccatgctgacgtccgcaggcccggagcctcttctatctttattcagtttgttagattttgtactaaaacagactgttatgctatctttcagacgattgtatttagtaaatcttagaagttcgtgggtattgtgacaccaatcttgggtagaggattttgttaaactttccgcatttctttcagttaattgtaatcgagacttccgcttatttaattgcttcgttctaattatattatcgaaaatattagttaaaatgtttgagcgtcggcttgcctagctctaatagtaggcgccatcacgactcccgatggtgaaaaatccgagtcgtgacacgcgcgatgcgcagaaatttgatagaatattaatctaataaaattatgatctaatatattatattaatttaataaattagttgtattttattatttaatacagtgtgcaggaatataatacaatcaataaaaaattaaaggatccaaattatatagtaatcaaataaattgatagtaaatttttttctactaaattataattttgaattcatcaaaagtataaagagataaatagtttttatatatatatatatataatatgcttatcttttatataaattagctgcagtatttttatattttgtatttttcatttgaattgaaagtttctttatttttttgttttaaaataattttaaaactctcacgtgaaactactccctaatttgaatggatattttttattatatgttttcattttttcattatagctatttttttgttttattttattctaaaatatttgtaaaactccaacttgaaactactccctaatttgaatgggtagttttttattttttttatttattatagccaattaaaaaatatgtatgtgtgtgtgtgtgtgtgtctctatatatatatatatagggataatgcataaaatccaccccatcctatgacccatttaccaactacacaccttttcttttcgggggtcctattacccccctgaacttatttttaccataattgatttaacattatatgttgtttaattgtaacgacccgaccggttgttttgagctccggtgcatcattcagcagtctgagggcatgagcagctttatttcaggtatattgatgtaatgacccgattggtcgttttactgtttagaatcccgttcccttagataaaactccccgcaccttccttagcataattatgacttgctggagtgattaattcgggagttagaagagttttggataagaaaagagccaagtattccttaaggttttctttaaaaagctagaattgacttcggtcaactttcttgggaaacggacccagattcgtaatttgacgatcccgggaggtccgtggaaaaatatgggacctgggcgtatgctcggaatcgaattccgaggtccctagcccgagtaatgaatttttgtgtaaaattattaatctaaagtttcaatgaattaaagaacctaattaattattaaaaacccaggtaacgaggtcggattccgattctgaaacttggtacaagttcgaaatattatataagacctacccgtaaagtttggtttcaatccgaatagtataaggtcgttttgacccgttggtaggaagttaagaacttggagttcattaagtttgatcaattagttttggggttcgattccttgatttagcgttgttttggaaattccggaggttcgactaggtccacctcgtgatttcagacttgtcggtatgttcgggcggggctcggaagccccgagcgtcaaatggtcgaggtttgagcgaagtcggatttttgaaggaagcaaggttgttgcttctgtcataaccgcgtctccggcttcttgaccgcagaagtggtgaccgcataagtggccacctggtcgcagaagcggaaagggccaaagggaaggagaccgctgaagcggtcccgcgtatgcgagcccctgaccgcagaagcggtctgccctgtgatgccccaaaccgcgaaagtggccccctgaccgcgaaagcggtcagcgcttaagcgctatttcgatcgcaaaagcggaaacaactggggcagaggggttcatttaattcgaaccccaagccatttctctcacattttcttcaacacttgggcgattttgagagttccaaagagaaggtttcttcacatctttgctaggtaagtaattttcactcacccttagcttaaatacatgtttatcacgtagatttaacactaataatcaaataaaatcaagggatagagttagacctagggttttggtaaaattatgatttaatcacctaattagctatgtaatggactagaatttacatattagtaatccttagggtatagagaatattttccttcgaaaaatctcggaatccgggcacgtgggcccggggtcgaaatttagaaaacttgcgggaaaggttggaaaatcacttatattagttagaatccaactttgtgaccgcttattgactagttcttgccttatttaactagtcggtgcttgttcggcttcgaattgagcttggagcctattcttgttgatagaaagagcgcttcggagcgaggtgagtctcctttctaatcttgtgagggggaatttaccccataggtaagttaaattgattatgtgctcctatttgtgggggctacgtacgcacgaggtgacgagagtccgtgcgtagccactattatgctattgttcgggtagtttaggacccgaaagcatgctatacttgtaatgtttgagatcttatttgcattcgaattgcttaaatcaaattgaactagtaaatgaatttcaaaacggattacgcatcatttttctcaaattgttaaaagaggattgattcttatttgatgaataatttccgaaaattcttaattgactgttgagcatgtattctgtgtgtacctgcgtcgcatgaatgattcgcgagcagggtatttgtttactttatgttgactgcgtcgcatggatgattcgcgagtaggttactgcgtcgcatggatgattcgcgagcaagttaccgcgtcgcatggatgattcgcgagcgggaaaaatagatgcatctattggttcgagccgtttgaccctcggcagtgcacaatttacatttttgttggatcgggccgtcgcctcggtgtgacttgcgcatgcttgtattgctacctggacttatttgagtttgttacatgccttattatggctcgagatcgtattgttaataataacaagaaatctaaggaacttatccatgaaaagaattatatgattacttgttttcctctatttggattagaaacatgtttataatacgaatccactgtttagtatattcataaaatgataaatagtcattggactactagtgagtgtcaaagttgaccatctcgtctctaccccttcgggattaggcgggacactcactgagtacacgttgatttacgtactcatactacacttctgtgcatttttgttgcacaggtatatgcgaccccagtggtcttcttgacatatcggagcggataattctgggactagatgagctgcatcattcgagacggccgcagctagggtagtccctctccagtattgtctttactttcgtccactgtattccggacgaatgatgtattttatttctcttatcagtagatgctcatgtacttgtgacaccgggttctgggatggtttgaagcattttatttatttgtttaactttaaaacttgatttgaaaatttgattccttagaatttctaaatgatgaaggaaaaatcctagattttaaaagtgttaaaaatgagattttgtttaggtaatttagttggcttgcctgacaacggtgtccgacgccaccacgacccttagcggattttgggtcgtgacaacatggtatcagagctctaggttcccagtggtctcacgagtcatgagcaagtctagtagagtctctcggatcggtacggagacgtctgtacttatcctcgggaggctgcagggctgttaggagtacttcccttcttgatttccttatcgtgcgatttgattcctctaaggcttatgcctttgtttccttcctactcattcttatgcgatgcgaagcgcttgttataaatcgagaattgaagaatttcgatggcattaccgatatggtgcagggtgttcctcccggtatggttgagtggactattatagtcgctctatggaaggatttcttgttgtttcggctcagcagcggtactctgagagctttgaagataggcacaagttgccatgatgcttatgaatgattcttcgcggtatggatatgatggcaagatgtttgcctacgtgtggaggtagtgaaagacttgaagggaagtttactcggttcatgatctagagattcggtattttattcctagcagggggaaaggtaatcaggctgaggatgtctgatgggatgatgagatgatgagacttggtatttcaagtgtaatggggtctccatcggcggcgtggtatcgtcatcctcgattgtatgtgttaagatcgtcagtgttattgttttcttctattcgcccttggggtaggatattgcgagtcagtaatgaagaagcgacagtcagagatcgcgggatgcggtggttcagaacggaatcggtgtccctaatgttgatgactcgagaaaggtgatcttcggaagggtttaaaactagtagcgacttgtgaatccgagagctatgaagatagattttatctaaggcaacaagtgagcagcaaagtatgaagaaggacatgtggaaagtgtcagtcggtctagaaggccaagtacgaggagcaaggtcgaatggtcgattaaagggatgagttccgccaaaatgggggagtggcgggtgaagcatatgggcttggtagtaggatgactacgttccttaaggagagtttggaatgatttgaggatttgagagattagtgattggggcctacggagctaacttgaagcataggccattatgcggcagaggattggatatagcggaagggagctgcttaaaatgagggagaatgcagcataactttaatgggaaggatattgccgcacaattaattaatgtccaagaggggtgcatggactagtgcagtcagagagggagcttgtactcaggaatcgggttaatgatgtcatagagattgtatctcgtgcaacaacatttgaaaatgtagggaagtgatttccgcaggtgagttatttcctgtgagcaggctagcggtcgcgtggttggcaaagcttctgcaaggaattctattggttagtcagcaaagtgatcagccatgcggatgtggttgacgattcagagttcaaaagagggtttttaccggacgattccgaggatttctgcagttgattgcgcaaagatatgtcaattaaagataaaggattttggtgaattcaagagttgggtaatggtggcttcgagctaagtgggggagtcccaccgcttatgattgggttgcatggtgaattactcgcgaggttttcctccatgggtatattggtgggttgtttcagttatgagaaaagaccctaagaggtaatttgagcagatgaattgctaagtgcatgttatggtaggccttattggctcaggttcagacttggggaaagattcatgatttatgccttgaatagatgcaggcttcatatgaagtgattccgtcgggtacttcgttgtgagggtatccatgtgttataactggtagagttggttgcatgcgggaccaagtcagagcgggtggctctcaacaacggttctagtgaattcatgaggtaaagtgtagttcctaatgatttgaatctataggtacggttaagagtcgagcttttgtagcagtttatgagaagaggcccagtatgtcctatgatgtgtgggcttgcggtgcagcatttgggaagaaaatgagaatatacttcggactcgaaaaagggttggcagaatgggcatatcagttgagggtgtgaatgtgcgcacaagagaggtatgaaacggttcatgggatttgagacggtatggtctcgtgattcgaagtcactcgaaatgagtgcagatggagtatgttatgtgttgaatgaataagtattatttctaaggcaatccagaataaattagaatgaagtagattgattaagccatagttgaattggcatattggtgtcagtgatcagctcgttcagcgtgatcgagttatgtaagtgatttgtggcggtacgtgtgaggcttgtcggccgccgtaattgattttattcagaagcattcatctgtcatggcctgttatgagtaggcggaccccggaagggttatggtggtttgaacccctatttagagattggcatatttgtcggttatgagaattcgccggtatgtcgctatagttctcctgaagcgagcaggaataaaaagttttatatgatgaagtgttagtctatcggcggttccagagttgtgatggaaatcgtgtctatcgtatatcggcacgtgaggtgctgtgattggtatggaatctaaagtaaggagcaagattgtagtttggtaatgactatgatgtcatgagctcggatgagctagaaaggagttgcagtgttttgggtaagttggtattggtgccagtatcacctgagatcggagttttgtgagaaagactttgcatcctagttaaggattcttgatcgcttttcagcgttagtgcagccggtggttagaatgtgcagacccgttaattattttggaagattgtgggagcttgttccacagtaagatcgtgtaagtgtgacatgtagtcacttgaatgattagaaatttaaaccaagtatgaggattttggtaatatcatcgatatgagaatttatgcctggtgggcactctgtttattgatttatggactgtggaggttgcttcagttaagatgaatgttcttgtgtgttatgagaaggggaaagttagcatggacccttgaaaggttattggcctagtttggcacgatcaggactgacttgaggtcggtggatggatttaaatgtaaatacgagctctatgccaggccagttgtatttatttcagcaagcgttccttatggagggacagttggggcatattctatcttcagctatttcctgtagtggtatattcgccgtatgagttgtgagacggcttggtaaattttcctatgtgttgaggttccgctcagcggtgaggttatatgagcaggatggcccttgaattcagatcatgtatcgcacctccgttgtgctcgagttttgtagcctatagcgctatatgttcccttagggatgaaattatgcaccttagtgtgtttatgaccgatattcggtattttgatgtgatgagctgtttagctcgatgtatacctccttatgtgagttcaatgtgtggatcgggtggcacgccgccatggttatgttgtttggatcgcgttgcgcgccgcaacagtgtaatgttcagtacggttcccccaattttcttttatgtgttctgtttcccattttcttaggaaaactcgtattagctgttagcccgcgtcgcatgtatgattcgcgagcggggtaactagatctccttttcagagttaggcttccttttcgtatcgcattctgagtggtagcctactggcccatcgtggcctcatgtgggacttttgatcatgtccgggatggcttattgcctgagtagttcgtactggatggaacgagatttattggacttaggatcagtgcaatctgatgagatgaagtatattaaggagctaagaccattagacggttcttgatggggaaatggtgcttgtcaggagtatagacccaatgggttgttgattcagcagttggctatgaatttctacacgtctcttctgtcgtatcggcgttgtgaaagctagagcaagacctatataggtcatgagatgcaatgagggcatcagatttgtggaatttcgactattatgtctaaagaatattgttgtggccctatgggtaaagtgatgcaaagtgtgaattcagcaaagttatacagtcatgcttgggtacagtgtgaagtgattgatatggtgatcgtatgttgaaaacaagcttggcaggaaatttcggatgttggaattgggctttaaggcttatttgcttggctaaaggagtgtatttgaggattatcgagctaatgtacccaactgggttgtggtggcacgggaaggtgcatgaggtgttaatcaagtgatttcagactacttcagtgtagttctcagcacgttcgaggacgaacgtatgtttaagtgggggagattgtaacgacccgaccggtcgttttgagctctggtgcgtcattcagcagtctgagggcatgatgagcagctttatttcaggtatattgatgtaacgacccgattggtcgttttactgtttagaatcccgttcccttagataaaactccccgcaccttccttagcataattatgacttgcgggagtcattaattcgggagttagaagagttttggataagaaaagaaccaagtattccttaaggttttctttaaaaagctagaattgacttcggtcaactttcttgggaaacggacccggattcgtaatttgacgatcccgggaggtccgtggaaaaatatgggacctgggcgtatgctcggaatcgaattccgaggtccctagcccgagtaatgaatttttgtgtaaaattgttaatctaaagttttaaagaattaaagaatctaattaattattaaaaacccaggtatcgaggtcgaatttcggtttccgaaacttggtacaagtccgaaatatcatataagacctacccgtaaagtttggtttcaatccgaatagtataaggtcgttttgacccgttggtaggaagttaagaacttggagttcattaagtttgataaattgattttggggttcgattccttgatttagcgttgttttgaaaattccggaggttcgactaggtccgcctcgtgatttcagacttgtcggtatgttcgggcggggctcagaagccccgagcgtcaaatggtcgaggtttgagcgaagtcggatttttgaaggaagcaaggttactgcttctgtcataaccgcttctgaggcttcttgaccgcagaagcggtgaccgcataagcggccacctggtcgcagaagcggaaagggccaaggggaaggagaccgctgaagcggccctgggaccgcagaagcggtcccgcgtatgcgagcccctgaccgcagaagcggtctgccctgtgatgccccaaaccgcgaaagcggccccctgaccgcgaaagcggtcaccgcttaagcggtatttcgaccgcagaagcggaaacagctggggcagaggggttcatttaattcgaaccccaagccatttctctcacattttcttcaacacttgggcgattttgagagttccaaagagaaggtttcttcacatcttcactaggtaagtaatttccactcacccttagcttaaatacatgtttatcacgtagatttaacactaataatcaaataaaatcaagggttagagttagacctagggttttggtaaaattatgatttaaccacctaattagctatgtaatggactagaatttacatattagtaatacttagggtatagagaatattttccttcgaaaaatctcggaatccgggcacgtgggcccggggtcggaatttaggaaactgtaaggccccgaaaaatttcgctaagtaatttaggatttcgtagtaccacgtaggctaattattatattttatgtactattaacatggtggacatcaattagactttttaaatttgagtacaagtcttatggtaagtgatgtgaggtccaaatggaagcctaagtgtaggcggaatgggaaaattttgtaacaggctaaaatttcaaatggattcgcacaaggctccactttaaaatagcatatctaatcttgtataaggttttgtgtggtgaatatcatatcaaatgaaaggtctttgattctagtttccaacgcttcaaaccgttcgtcattcggacattcctacacaaagttatgatcaaattaccaaatgcagcgaagaattttgcactaccgtgccgcacccatgcggcgagcccatgcggcgcgatagtgcaaattatcagagacctccaattttgttccagaaagcattttccactaccgcggcgcacccatgcggcgcacccatacggcgcgacagtgcaaattttcagtcttctgttataacccgacccaacttcattaaaaacaccattttccctcattttaaatcatttctatcgaaaactagagagagggagagagggtttcttgagagagaaagctacatcaccatctttggatcttcctaaatccttgaagcttggattcttcttgctccattgtcttccctgaagtgttctaaggtaaaatccctaacccttttttcccccattttcgaaacctagcttaaaattgggatttctttcatctatgtttgatatgctaaacaaaaccatcatgcacggccttaaagctctaaactctagctaaaatggaagttgggtagtaactttaaactaatgctaagatccttgcatgttgaccttgaaaatagattaaacttgtgccttgctgggtgaattggactaggagttagaagcgacattcgctcccaggtatgtatggctaactttgatccttgtgaaatcgccttgttggtgtgtaaattgctggtaattgaaatctatgtgggtcatttgtgaacttcatgtgtttggtataattgtgattgcaccttgtgataaaagttgtggaatatgtggttaaaggaattcttcaatggtgaaatcggaacaatcgtgataataatgtacttggttggttgtggacatctattgtggtaactcgaattgttcatggactgttgaatatgatgaatttggtattattggccatggaaacacttgaaactttgttgtggttgtaccttaagaggtgttgttgttactcgtggtgatgtgtttaaagaggtgttgttgttactctttgtgattgtttgtttgttgtgattgcattgtttatgaattgaaaactatcaggcggggtcgggttgcacgccgcaacacggtgaaataaggtgtgggttggtgcgataagggtggccgaggtaataagggtggaaaagtgatccaatatcactattgaaatgagttaaaatcgtgaaatgataaatgtggaattgtgaaaggagacagcaggagagtttgcaacctgtggggcactgattgcccctttgtttggctaattgaactatctgttgtgaagtgtttggttgatgtttccattgttgttcagctgcttatttgttcatgtatcatcggctttctattgtatttgtatcttggcttgagtttacttggaacagggtttgttcaaacataccagtacaattccaatgtgctgacgtcccttttgccgggggtgctacattcgtgttatgattgtaggtggatccgtagctggcactccagtccaccgtccgtagctcctcctcttctacttatcagctgtgttcaaattggtaagcccctttccttctggggcctcgtgtggttcaggccacctctgttgttgtagtaattatggttttgtgttgtttggtaaaggtatagccagggccttgtcgccggcaagtattgtatcatcttcaacttcttagaggctccatagacagtacgatgcgggttagaacttatgtatgcatgtaatgtatatgttttggcgttgtaatatgtaaaccacgctagctgttagtgataatatgtatgtgttgtaaaagaggattaccagttatttttagttgcatcaagtgttatttggttaatcaataaggaataatgtggggtaacgcgtgggaataggaaaggcacccaggtccgctcgactggggatacctggttgagtgccggtcgcgccctcgaattttgggacgtgacaaacttggtatcagagcctaagattttaaagtgtcctaggatgtctcggagccgtgtctagtagagtccttcttatcggtgtgttgtcgaccacatctataagttggaggctatttggacatttaggaatttcacccttctttgaccttccagatcgtgcgatatggctcaagatagggagctaatttcctctctaagtattattctcaagattggtaattttgataccataatttttgaatttgaagcatgtaaggagggatttatccccaccattgagtccgagtagattacccaaggacttgttagaagaatgtgttgagccatgaagtgattggtagaatttgttgttaaggagagtacccttgtcccaactaatgccactgccccaccaggttatgtagtatatcatcagtatgtacggataaaaccccatctttagaaatcgagcttcgatggtgctcgcgtaaatgttgtaagttctaaatataattgatgcaatacttgttttgttacgttaattgaattattgttgtgaaaatataagtgggaggtacttcttcatgtgttaatttgttattcttggtaaatggggatatgtgaagaatgtgagctatgttctaaaatgcctagacttcaagtcaagttcaaattgagattttgatgccaaactgtgtgagaaaactcgttatggttgatcctccaaattgttcctatgtgtaccaaatatattggattgcttgtgtctagttgttggtaatgtacaaagatgttttgaggtaaagtaagtgactgtagactgaatgttggattcttgctgtgattgatagttttcatgatttggtgttgtgacccgatggttgtgaaagatacattcaaatatgatcaatgtgctattattgacaacttaaaaagggtgcagggaatatgaatcatgtattgaaatgctaagacccttaattgaaattggggctgcatatattatgtcaagttatgtgaaatcctaggtgtatagagatgttgaaattgtataatgtcatgattgaaaaagaaggattcaagaataattggtgtaattgcttgcttatgcctttgatgtgtgtttctattgtgggttggtgtgtcccctctatccatttgaaagaacccgttgtgtttaaatttccattgccaataaacttgaggtgtatgatttatgagatattgtatacgccgaggattcgtgattcctctcatgtgtacttgatatcttgaattaactgacttgttgttgaaattgttattgatgtgaaacaagagggactaatgtgaaatatgggaaagaagagattgagttatgaaatgtggcctagtgccaagtatgatatgataattgtggccccaagtgcctacgaattgatattgatgtgaaatatgcggagatgatgtgaaatgtgggaaataagagattgtgttatgaaaggtggcctaatgccaatgatgatgtgacaattgtggctccaagtgccgacgaactaatacatgtgataatggcatgactcttttatttgaaaatgtagtgagcatttaaagtgtttgatttgtacttatgatttccttattattgtatggaatacatagatgtataatttgatatgtgagccctatggaagggctatgaaatgcagcttagaggtatggaaattatgtgacaaatatgtgattccttttatttggtaatgtggtaattgtttaaaggttttgttaaacccttatgatttccttatacttgcatagatatattcttaagaagaatctaaatcactaaacattgcatgcacctgctcttttaatgagacgtattattcacaaggtctcccggtcatggttctcttatttatggccttctgtggaattgagctctataattatgttcctgaattgagttataaccctattgatatttctcacttgattttcctaaatccgcaataaggtatcattcccgatgaatttcttattgaggttttttatttaattggacaaaaatctactcacttgtgcctacacatgcactgtcgtaaagtttacctatgtggtttcaagtttcatgtaaagcatccctgtattgcgatccttctttagtcaagttgtgcatatggcttatatggtttgaaaacccaatctacgctcttgagagtatcatcatgatggaagtttctcagtgtctagtaatataagagcatagcttaacacctatcatatgagtgcatatcaatcgaaatggtcgccgtgtacataaaggttttctaaaaaattgagatccacacatccccatcacaggaagtttgtgtgtcaccataaatttcttatccacttaggttatcccgtggaaagtatctcacttggtttctagtattgtggtcgcccatgatgtggtcttgtatcacagtcagagagttaacatagtagaagcatgtccatcttgtaaccaatggttgttttctcttacacctccgtaacatgtgttaattgtgatttttagttgatgaaagtgacggtgctagttcccaacacttattcgataaccgtgagagaacgtgcccttctatgtgtcactatgacacttcctttttcaagtcaaaacctatggagggaccatcatgaacatctgtaaaccttctaggattattgtgcattgtctcattgaatttggttgtctttatacactcaaacttctagaatcattcactatgtcgttgtcatgtaccgggagtttttctacctttggtaactcacttacttggctggataggattgttatttgactttttcccggagcatcattttgactattagaaccatctaaccaattcatgatttcttcccatgtcaagatgtcctagctatggggtttcacttgtgaaaggttgagattagatgcctccagatttttgcacatatcatgagcatatttatttgaaagactaagttatcgtatctttagttctctcatataggaccaactatcatggcgggttaagttgtttgataatatgatgatctcataagtgtacaactctttttccatcctcatgggcttgtggcatagattccttgtgtcagttaacattaagagtataattcaacttcatgtgttttgcaatccatatcgcattcaaggtgccagaatattctcattcttgataaactgactttcccaacactctaggagacgactgggtcccgaaattgaatattcctccttagtggttcctattgccaatgtatgagttaccccgatgccttaattgcctaatagttgatgtcgtcacaatgattaaccatatcagtatcatcaataggaatcctcgtgcctcttagcatgtaacctcatgaaatgctctgctcagttcctaaatggattcctgaataatcccaagcccattcttgaactctgctgttccttactgtactagatctagtgggtattgaatgttaaaacatgtcacagaagaggtatccccgtgtgatccgatatgttcgataggtaatcttatggtcagtttatgataacccatcttagagtaattgttgaaggtcatcaagggtttagtgtgagtgttcacctagagatttagagtttggagggtgagcaggctattctcaatatttttcccctaaagatgttaggtgagttgataatgaagattgcataagtgttgttcgctataagccatgcaatgagtatgatatttaccatcgttgttttacatgtattatgtgttttaatatgcctatgtctaagaaggtagtggtaaaagaggggtgtgagtggatttgattgaactacatgatcacggtaatatactatatgattcactactagaaagaattatcgtggcttgacttcatatggatggttgattgaaatgaaattatgttcttgttgatgaacacctttgtgattacattaatgactggtagggactactatgaacacatgactgtttggttactattaaatggcattcttgatggtgtgatgccatgtgatggaaattgtgggttgttgttgttaccatgaattgcaataaccggtgggatgtaaattgtacagtggaaactattgaacatgaagttattggactgttagcttatgcgaggtatctagttatcatcctttttaggtaagtttgaagattgggattatttttgcaaatgggttgtggtaaggcttgtaagtcgaggaggccacattgaaggccgaaagtatcgtggaaagaaaatattttcgcttgattgtataacaattggttttgatttgaaaggtaccttataggtgttgtgatttaaaaatgtgcagtccatgttcaggtattattatgataatatagtgcgtgtaattgtgagattagtattgttgatatatacattcgggtgttttgttgagttgtggatgtgttttagggatggttttagtcgttctctgacaggtggataggcctagttacaaaggaaactctgccgaaatttctgaagaattttggagttagtcaaaatttagggacttgaggtaggttagaaaagagttgtgtgatgttaaagtgtttggggaagactctactcctcattcgaggacgaatgatcctaagggggggagaatgtaaggccccggaaaatttcgctaagtaatttaggatttcgtagtaccacgtaggctaattattatattttatgtactattaacatggtggacatcaattagactttttaaatttgagtacaagtcttatggtaagtgatgtgaggtccaaatggaagcctaagtgtaggcgggtatggaaaattttgtaacatgctaaaatttcaaatggattcgcacaaggctccatttaaacgagcatatctaatcttgtataaggttttgtgtggtgaatatcatatcaaatgaaaggtctttgagtctagtttccaacgcttcaaaccgttcgtcatacggacattcctacacaaagttatgatcaaattaccaaatgcagcgaagaattttgcactaccgtgccgcacccatgcggcgggcccatgcggcgcgacagtgcaaattatcaaagacctccaatttcgttccagaaagcattttccactaccacggcacacccatgcagcgcgacagtgcaaattttcagtcttctgttataacccgacccaacttcattaaaaataccattttccctcattttaaatcatttctatcgaaaactagagagagggagagagggtttcttgagagagaaagctacatcaccatctttggatcttcctaaatccttgaagcttggattcttcttgctccattgtcttccctgaagtgttctaaggtaaaatccctaaccctttttcccccattttcgaaacctagcttaaaattgggatttctttcatctatgtttgatatgctaaacaaaaccatcatgcacgaccttaaagctctaaaatctagctaaaatggaaattgggtagtaactttaaactaatgctaagatccttgcatgttgaccttgaaaatagattaaacttgtgccttgctgggtgaattggactaggagttagaagcgacattcgctcccaggtatgtatggctaactttgatccttatgaaatcgccttgttggtgtgtaaattgctggtaattgaaatctatgtgggtcatttgtgaacttcatgtgtttggtataattgtgattgcaccttgtgataaaagttgtggaatatgtggttaaaggaattcttcaatggtgaaatcggaacaatcgtgataataatgtacttggttggttgtggacatctattgtggtaactcgaattgtttatggactgttgaatatgatgaatttggtattgttggccatggaaacacttgaaactttgttgtggttgtaccttaagaggtgttgttgttactcgtggtgatgtgtttaaagaggtgttgttgttacactttgtgattgtttgtttgttgtgattgcattgtttgtgaattgaaaactattaggcggggtcgggttgcatgccgcaacacggtgaaataaggtgtgggttggtgcgataagggtggccgaggtaataagggtggccgaggtaataagggtggaaaagtgatccaatatcactattgaaatgatttaaaatcatgaaatgataaatgtggaattgtgaaaggagacagcaggagagtttgcaacctgtggggcactgattgcccctttgtttggctaattgaactatctgttgtgaagtgtttggttgatgtttccattgttgttcagctgcttatttgttcatgtatcatcggctttctattgtatttgtatcttggcttgagtttacttggaacagggtttgttcaaacataccagtacaattccaatgtgctgacgtcccttttgccgggggcgctacattcgtgttatgattgtaggtggatccgtagctggcactccagtccaccgtccgtagctcctcctcttctacttatcagctgtgttcaaattggtaagcccctttccttctgggggcccgcgtggttcaggccacctctgttgttgtagtaattatggttttgtgttgtttggtaaaggtatagccggggccttgttgccggcaagtattgtatcatcttcaacttcttagaggctccgtagaaagtacgatgcgggttagaacttatgtatgcatgtaatgtatatgttttggcgttgtaatatgtaaaccatgctagctgttagtgataatatgtatgtgttgtaaaagaggattacctgttattttcagttgcatcaagtgttatttggttaatcaataaggaataatgtggggtaacgcatgggaataggaaaggcacccaggtccgctcgactggggatacccggttgagtgtcggtcgcgccctcggattttggggcgtgataaaaacttgcgggaaaggttgggaaatcacttatattagttagaatccaactttgtgaccgcttattgactagttcttgccttatttaactagtcggtgcttgttcggcttcgaattgagcttggagcctattcttgttgatcgaaagagcgcttcggagcgaggtgagtctcctttctaatcttgtgagggggaatttaccccataggtaagttaaattgattatgtgctcctatttgtgggggctacgtacgcacgaggtgacgagagtccgtgcgtagccactattatgctattgtccgggtagtttaggacccgaaagcatgctatacttgtaatgtttgagatcttattggcattcgaattgcttaaatcaaattgaactagtaaatgaatttcaaaaaggattacgcatcatttttctcaaattgttaaaagaggattgattcttatttgatgaataatttccgaaaattcttaattgactattgagcatgtattctgtgtgtacctgtgtcgcatgaatgattcgcgagcagggtatttgtttactttatgttgactgcgtcgcatggatgattcgcgagtaggttactgcgtcgcatggatgattcgcgagcaggttaccgcgtcgcatggatgattcgcgagcggggaaaatagatgcatctattggttcgagccgttcgaccctcggcagtgcacaatttacatttttgttggatcgggccgtcgcctcggtatgacttgcgcatgcttgtattgctgcctggacttatttgagtttgttacatgccttattatggctcgagatcgtattgttaataataacaagaaatctaaggaacttatccatgaaaagaagtatatgattacttgttttcctctatttggattagaaacatgtttataatacgaatccactgtttagtatattcataaaatgataaatagtcattggactactagtgagtgtcaaagttgaccatctcgtctctaccccttcgggattaggcgggacactcactgagtacacgttgatttacgtactcatactacacttctgtgcatttttgttgcacaggtatatgcgaccccagtggtcttcttgacatatcggagcggatgattctgggactagatgagctgcatcattcaagacggccgcagctagggtagtccctctccagtattgtctttactttcatccactgtattccggacgaatgatgtattttatttctcttatcagtagatgctcatgtacttgtgacatcgggttctgggatggtttgaagcattttatttatttgtttaactttaaaacttgatttgaaaatttgattccttagaatttctaaatgatgaacgaaaaatcctagattttaaaagtgttaaaaacgaaattttgtttaggtaatttagttggcttgcctgacaacggtgtccggcgccaccacgacccttagcgaattttgggtcgtgacattaatcaattgatttaacattatttctaccataattgatttgacatgtcgggtttaattgagcatataatgttaaatcaattatggtaaaaataagttcaggggggtaataggacccccgaaaagaaaaggtgtgtagttggtaaatgggtcataggatgaggtagattttatgcattatccctatatatatatatatatatatatatatatatatatatatatatatgtcacgaccctagttcaccatctgtgaacatgtcatgatggcacctgaccggcgaggacaggtaagcctaattcaatgcggaagaataacatttaaataagaaaggataaacaagctgattaaacttaagaaaatgtaataagtgccgcctggcacatacacttagcaatacaatcatcctgaaatctatcccaagacccggaaactcacgggcaacacaggctaagaattttacataaactgctctaaccatccggaatagtctagtacaaaggaaaatgggataacatctggctaataaggatagagtgagagggagactcataggatctgcggacgtggcagatgaatacctcaagtctccgtacaagctccctgcagctgttgataatatgcctgcgtagaggtacctggatctgcacatggaaaacatgcgcagaagaggcatgagtacaccacagcggtactcagtaagtgcccagcctaacctcgattgagtagtgacgaggaaggtcgaggccctaccgagatagacataacaaggtaaagatatgcagtatatatataggtgaacagttgaacattaaagagtgacaacagttaaaccggaaaactacgaataacacagtcaaagaagacaaggaataggcacagcaaaacgataatcaaaccaagtactcagaggatctcccaggataccgtcctgtagccctttctcaactgtctcagtggagctcccgggataccaactcgtagtccatcatatctgtcatatccgaaggatctcccgggataccgacccgtagtccaacatatcaatcatatccgaaggatctccagggataccgacccgtagtccaatatatcaatcattttcgaaggatctcccgggataccgacccgtagtccaacatatcaatactcagtactgggggaatctaccggctacattgccgtagttccatacttttgtgcagggggatctcccggaacctcacgtccgtagtcccaaagtaacaaacaaggggaactcccggaatcccacatccgtagtcccaaataaatacgcaaacacagccaaaatatactggaactgaacatgagctaacaacagatagagcaactagcctaacatgcttcacatattacatcaagagcaaaataagcatttaaacggttaattatatctaatcatgctttactatctaacacaggttgagctagcattttataacagtcaaataggcaagaagacacagtgtaagaaattcaagtaaggtggatttcaacaattagcacaagtgtacgcccgtcacctcgcacacaaggcgtttaaaccaacaacaagcaaatcttaggggtaaaggtcccccacgcaaggttagacaagccacttacctcgaacgggtaccaaaatcaatatgaagcgaagcccttgccacgagtatccaactccgaatggcccaaatctattcaaaccagttacaatatataaataacaatgcaattaactaattacactaataaaattgaagctacggcgcgaaaataggagaaatgaccaaaacgcccctcaggccaacgtctcggaatcagaatattttcacatttttagaaacctcgcgctctcacgagtctagccatataaaatttacccaaatcggaggtcaaatgctcactcaaaaactcaattgattagtctaagaactttaacccatttcctccatttttggacctcaatttgaatttaaaagatggattaagcaactagatgatagattaaagctagaaatgatcaaggaaacgttacccaataatctcctcttcaaaatcctccaaaaatcgccttggtccgagctagaatttgatttttcaacttatgaactcaagcctcggattaaaccttttttcttctgtgatttccgcttaagcggttccctggccgcttacgcggtcccgcttgtgcggtccaaaatccgcttctgcggtttctcattaaaatcccagcggccgcttctgcggctaactgaccgcttaagcggtctccgcctatgcgacactccaaccgcttatgcggtaaaggtccgcttctgcgacccaacttccgcttaagcggactccgcttgtgcgctcccctttccgcgaaagcggaaacagcagaagcctgctgcaatttttcccttcaacttccaaatttaaatccgttgaacctccgaaacacttccgaggcccccgggacctcaaccaaacctacggacatatcccataacaacattcggacttgcaccaaaccttaaatcaccaaaaacaacaccgaaaacatgatttaatcattgagttgaacctaaaatttccaaaacttaaccaaaatcataaccgatgccgaaactaaccaaacgaggtccgaatgacctgaaaatttgcacacacatccaaattcacctaacgaagctactgcctctctcggaattccattccgagtctcggatcaaattctcacctatcaaccggatacttcaaattttcaactttcggcatttctaggctaattgagctacggacatccaaaatacaatccggacacgctcccaaccccaaaatcacctaacggagctaacggaaccatcggatttccattccgaggtcgtcttgacactgttccgactacggatcattttccaacacttagactctcaaataaggactatttgtccaaaaacactccgaattcagataccgaacatcccggcaaaccaaaatagtataaataaacttagaggaagcacttaacggagaaacggggcgcaaattctaaaaacgaccggtcgggtcgttacaatatatatatatatatagagagagagagagagagagagactactatattagaaagaaaccactcctcaatttaaattggcagtttttattttttatttccgttttttattttaaaataattttaaaactccaaattgaaaccataccccaatttgaattggcaattttttatttccttattttcgttttttattttaaaataattttaaaactccaaattgaaactattccccaacttgaataggtaggtttttttaattaatattttcatttttttattgtagctaatttaactttttattatttttcatttttttattttaaaataactttaaaacaccaactataaactactccccaatttgaatgggtagttaattttttttttatattttcgttttttaatatagctaattataatatatttatatttataaattcaaaaagagtaactaattaattcaaaatgtaaaaagtttttttagttaaaaaggcagtttattttgtcttaacaatgccacttggctttttgtgattatgccacttgtcttaataatatgcttttaaattggcaatttttatttttttatttccattttttattttaaaataattttaaaactccaaattgaaagcataccccaatttgaattggcaattttttatttccttattttcattttttattttaaaataattttaaaattccaaattgaaactattccccaacttgaataggtaggtttttttaattaatattttcattttttattgtagccaatttaattttttattatttttcatttttttattttaaaataactttaaaacaccaactataaactactccccaatttgaatgggtaattattttttcttatattttcgttttttaatatagctaattataatatatttatatttattaattcaaaaagagtaactaattaattcaaaatttaaaaaagttttttagttaaaaaggtagtttattttgtcttaacaatgccacttgtcttaataatatgcttttgcatctccttttattatatatagattttcatttttctattgtagctaatttaatattttattattttttatttttttattttaaaatagctttaaaacaccaactataaactactccccaatttgaatgggtagttatttttattagctatattttcgttttttaatatagctaattataatatatttatatttattaattcaaaaagagtaactaattaattcaaaatttaaaaaagttttttagttaaaaaggcagtttattttgtcttaacaatgccacttggctttttgtgattatgccacttgtcttaataatatgcttttcaattggcaatttttatttttttatttcctttttttattttaaaataattttaaaactccaaattgaaaccataccccaatttgaattggcaattttttatttccttattttcgttttttattttaaaataattttaaaactctaaattgaaaatttttagtcaaaaaggcagtttattttgtcttaacaatgccacttggctttttgtgattatgccacttgtcttaatattatgcttttaaattggcaattttttatttttttatttttgttttttattttaaaataattttaaaactccaaattgaaaccataccccaatttgaattggcaattttttattttcttattttcgttttttattttaaaataattttaaaactccaaattgaaactattccccaacttgaataggtaggttttttttaattaatattttcttttttttattgtagctaatttaatttttattatttttcatttttttattttaaaataactttaaaacaccaactataaactactccccaatttgaatgggtagttattttttcttatattttcattttttaatatagctaattataatatatttatatttatcaattcaaaaagagtaactaattaattcaaaatttaaaaaaaaaatttagttaaaaaggtagtttattttgtcttaacaatgccacttgtccctttttgattatgccacttgtcttaataatatgcttttgcctctccttttattatatacaagtcatatattacaacccgaacttagtcgaaccttcgaaacacccaaaacaacacaaaaacaccaaatcaacctcgaattcaagcctaagaacttccaactttcgccaattcaagcctaattctaccacggatctccaaattatatttcggacacactcataagtctaaaaatcatccaacgaagctaatcgaatcataaaaatccaaatccgaattcgtttactcataagtcaacttccgattgacttttctaacttagctttctaactaagagactaagtgatcatttcactccaaaactactctgaacccaaacctaccaactcgatacaactcaacacaactgaacaattgtaaagaagcatagatggggaaaatggggctataactctcaaaatgacaggccgggtcattacaaacacatcataagcaaagatgctaactttctgaaagactataaatcaccaacagggaggggaaaaaaagtaaaattacgcaatttaccttagtttttactgaacttataccaatttatataatcaaaacgggagaaaaaatatggcatctgaaacacaataagctactcaaagctgaataatttcgggacgaaaaaacaaattaccgtcaaaatcgacaacagtagttcagttgcaccatttatcagcctcgatcatttcttttttgagttttcagatagcagtctgatatttatcatagttgtccgtcatcggagaaatacatttctacctgtggccaagttctaccatgagagagagcgcaaacgattaggctgatcgaccaccaagaacaaattaaatttacataaatgggcctaaggaaatacgggtaataacaaaacctaagcgcgcgcgcgcgcacacacacatatatatatatataacaattccgaaaatcaaatcgaattagcaaggtaataacatatgtaaaataccttttcatcttgtagaaccaattcaatcgagaatatagtgcctggattaaaacgatccggtacttcccacatacggacaacacaaacttttaacttccattgcatcttcgaaattgttatatccttgatgaaatctaagtgaatagccatcttttgcataagccgtaactttccttgaaatcttgatagaagaaggaactttagaattgaagaacgtgtagatgaggaagaaatataaactcctctacgcttttgcagttgataccagtaagagcagttgatacccagtataagatacgtgggttaagcagttgaatccatcgtgcttttgcagataaaggaatttgaacggttttgaagtccatgcctatttgcagtagagaccgccggttatttagtattagaatgagttaataattgaaaaaaaattagaaaaagggccgcaggttatttagtattagaatgagttaataattgaaaaaaaaattaaaaaaagaaaattgcacagaagttgaaagagtttgaacgatttacaactgaaaggtgtagaaggccactcctatttttgaggaagctggcagtttattccaaatatatatataatttaataattgaaaaaaaatctataaaaaaaaaattgacagaaagcatacggtttagtgaaaaatgtttttcaaattaatctaaatagtttagttcctaataattaggagcaatgtcttaacatgatatgtgtcatgttattgttgtgccacttgacttcatgtggggcttttgtttttggcttttaattatagatagatagatagattaggaaatttaatctttgacctttgatgaaggcagcctagatcacctttttcatagtattttgacgcgttgaagttcctttaatgacaaggtcaaacaggggtatggataaactcaaaaaatgactgacggtaaaattaagtaatttcgcatattatatactataacaaatttggacacccttttcccttttaaaagaaaaagtagaaaacgtcgttgatgcacaatgaatttccattgtgtactcttgtagtgtaaacctgtttcgtcttaattaccgggaaaaaaaaactgtttcgtccttttttttgggcgaaatatatacagagacactaaatttatcaaaagttttcatttagacacttaattcaacccattatctattgagcacttgatttttgcttaaaccgcttccactagacacaaggtaatgagacaatgaaaagatggatggcgtgtagttcacacgtgggtgaattagaaaaaagccaataaaactaaggcaagtggatgattcgagatgtggggtccacaagttttatactggagctttgttaatggcaagagtaaatatgcaataatttgctaactaaaagaatataaatgaactcgaagtgtaatcgtaggtaaactcgaacaatttggataatacacagacaaatttaaacctttttctttaaaaaaaaaaaaaaactcattggttcacaatgaatttccattgtgcactcttgtagtactgtgaactgttctttcattttctttgtcccctcttctctccttcctggaaccatcgtttgtatctatcaggaaatcttaagctcttttggattattgtgtgcagaggcggatccagaattttaagcttatgggtttctataacaatctcaagttaatctacatgaagactggaccaacgaattgggtttcaaactaaatattcttatacttttagtaaattttttagtataaatatagggtttatgtaaaaattactgggttcacaggaacccgtccctttgctctacatccgccccagattgtgtgtgtctcattagacttagcagaacaaaaatctaatttttaaaaacggaaaagggtcaaatatacccctctactttcaaatatggtttacttatacccttcgttatactattgggccatatatacccctactgtcatactttgggttatatatacccctactttggatggagtgccacgtgtcagcaccagattaaacgaccaattttcttttttttttttacccgacccaaacccacaacccgacccaattttcgtatttttcattttttttaaaaaaaatcagttttaaaaaaataaaaatattatgttaaattttttttttcttattttgcaaatttattttttccagtttttttttttaaaatcagttttaaaaaaacaaaaatattatgttaaattttttttttcttattttgcaaacttatttttccctgttttttttaaaccgaatttttttaaacaaaaactaaaaaaataaaaaaataaaaaacttacaaaactcagtttgtaaaaactgaaaatttataaaaaataatttttttttataaactgaaattttaaaaaaaacaaaaacagtttttacaaatttaaaaaaaaaaatcagtttttataaaacaaattcagtttaaaaactgaatttgtaaaaaatgatttttaaattttcagtttataaaaactgattttttataaattttcagtttataaaaaaaaaattaacataatttttttattttttttaaaactgctttttttaaaaaaaaaaaaatagaaaatacgaaaaatgggtcgggttatgggtttgggtcgggtaaaaaaagaaagaaaatgggtcgtttaatctggtgctgacacgtggcactccatccaaagtaggggtatatataacccaaagtatgacggtaggggtatatatggcccaatagtataacgaagggtataagtaaaccatatttgaaagtagaggggtatatttgacccttttccgttttaaaaaagtagttgtaccattttgtcccattattgagacatcatttgcattttagagtcacggggatttccatagtacccaaaaatttccaataaaagtaacttttaagattttgaaaatatagttgaagaattaaattataaacgaaacattattagttcagatgatatagactactttgtgataactgaatatattatttaaggcaaaatatatctggatctcctgaatttgacgacttttattttgtgtacgtatgaactctatgttagacttggtagtttgataacattgacccggaatcggaaggcattgatatggcaaagagcatgaatgcattctcttttagcgcatacgagggaaaaaattgaaaaatcatctttcaagtgggatgttttcaactattaattgccacataatgaaatacaatgatttatttatttcaatgatgaatgaattgtaatattgcaaggatgaataatgtaggaattactaatttctttttggatgtttactttcatgatataataatgcaaattgccgtacaataagttaaaatgtgtttagttttaaatagactataagtttgttcactattatgtcttttagtttttgtcactttaatgtttttaatttatgtattattaataatactcacattctcatgtcacattctattcaatataaaataatataattgatttaccgcgaaattacacagaagcatagaccaaactgtagcaagattgaccaacagaaaaattattcatcttaaggaggacttttataaaatgctacaattactagtactaattaatagcatgtcaagtttaaagaaaaacaaaacttattttgataaatattttcctcaaaaatatttttttcaaaagtacttttgtagaaaaacaacttgtgtttgactaattaatttaaaaaatacttctgagaagcaattaatgtttgaccaaatttttaaaaagtgcttttaagtgtatttttctcaaaagtatttttaaaaaaaaaattcttttagggagaaataatttttactgcctttccaaaactgattctgcttctactcaaacacactttttttttctctctaaaagcttggctaaacacttcaactttgaaaaaaatacattaactttgaagaagcttggccaaacaaataaatttacctagtctgttccccaaaagaaaaattttaattcttatgcaatttaacttatgttttttaaaatgttatgatatgcgtaaaattaattttataaccatacaactattatgatatatttaaaatcataactttcaaaagtcagtattataaattgaaatgaaatgagtatctttcttctaggtcaatgagctcatagggtccatttggtaatttgaaattaattttgtcgtagtcccacttgcccccttatataattaagacaagtgaataagaatccaatgtcactcaaattttcatttgtagagcaagttctttgcattccagtacttgtcaacaaaaggtatccggccatcggctaagtttttgaggtaactccagttttccaattttatgattatgtaggaagaaattcaaaaatagccagatttataagtggtcattcaaaatggagtttcagtataagtaaattggaattccagcatattataatggattttccagcataactatactggagttccattataatatcccggtccaatataatatgctggaagttcatacacaggtgctccaatctccagtatattatgctggaactttccgcgtgttggagttacatcataatatgttggaagttaatacacacaggtccactgatctccagtatattatgctagaccggtccctattgtagcaaactagtggctatttttcaatgactttgcaaacactggctatttttgaatgaccagtcctaaaactggctagttcgtgctatttttatgattatatattgtgtaacatttacgttttcatgagatcctttagctatataggacccgagttgtggtgggatggtaaggattatactagaggcggagccacaatattagctacgggttcagcctttgattatcaccctcaatcaaaagttttagatttgaaacatcgagaaactaagaacttcttggtagggactttacgcccttattcagcttgtacgaattagttgaactagtgaaatttcaatactgaatggttcaaaaaaaagaaaagatactttgggaagcctaaaaagaaatactatgacatatgtttaagactaaagttttacctttctttgtcaaatttcatgtccagtcaaatactgtcccataaaatggaagacattagaatcacaatggacgacgctccgagttttcctcaaatacccaaaattccattagtcatgagacttgagaaccagaacatgagcgatgactttgatcctaaagtcgtttcattggggccttaccatcatggaaagccagagctcaggtttgttgaggatttcaagcctaagtctctagaaatgtttattacaggcagtgataaggaccaagatttcttgctcgagaagattctagaagagatcgaggttactaaaagttgttacatggaagaattcacgagtcaatataatgacaatgattttgctcgaatgatgcttcttgatgcatgttttgttctaaaccttattgagaccgaaacacaagactcgtcactatgttgttctaaagtttacaatactattttgcatcttggtattggagttgtttcctttattgtccgtgacatgtttttggttgaaaatcaagtaccttttcaagttctcaaactcttgttcaacttgagatttggtggagatcatggatttgaagaaatgtcgaaaacctattgttataatgttcttttcggccaacacgagcccaaaaataataatgtgtcaatggatccacaacccgctcacctttttgaaatttttcgaagagtggttgtccgtagtactactacaacaacaatccagcataatctcacaagtggagtcttggaagtggttgtcagtagtcgtgatcaacatatcacgtattcaaatgttgatagtaccaacgaacagagacgactgacaactagagtaatggatcttatatcaaaaggcatgaatcattgtggatgtcttgatgagaaggaagaaggtgacacaataacagaatcatctcatgcatttcattcagtaatggagctgaaatcaaagggcatccattttatgcctagcgggtttgggtctttattggatgtaaagttaacatcacattatttctacgcgaaactctcacttccatgttggtatatctcaaaatatactagagtatttttccgaaacatgatagcttatgagaccagtccaggtaaatttgacgatttacttgtatctgcttacatatattttatgaaaaccctaattatttcacctaatgatgcgagagaactacgaaggaagaagattatattcaacacattgggaagtgatgaggaagtagtacaagttttcaaagcattaaacacttatggagatgagtatccatatatttacaaggatgttaaggaaaaaattgaacaactctttaacaacaagtcacaaacttggattgctgaattgttggatacttattttaggagtccttggtctctacttgctttgcttgctgctacttcccttcttttccttactatcctccaaacttactttgcatctccatttcattcttatgtaaaaaaatcttgatttgtttacaatattatgttgaatgaattaatattccttccatatatacattttctcatgtattactttgttgtattttcctatgattgttgacaacaatactaagtttaatatcctcttcgagcgggagaaattcaaaaatagctagatttacaagtggttatccaaaaatagacacaattgcaaaggtaatcgaaatttagccacatatcatgcaaagataaatctgcacgaaaatactgttaaaaattcgaaaaaatactccagcataatatactagagttataatatactggagtttggagcaccggtgctccaatctccagtatattacactggagccagcaaagtataccggtccatcataatatactgaaagttcatacataggtgcaccgaactccagtatcttatgttggaccggtttctgttgcagcaaaataaaggctattttttattgaattggtaaacgctagctatttttgaatgaccagtccgaaaattggctagactatattttaactcttcaagttcaccctttattgtatatcttgattttcatgccatccaaacttagacattaattctatctcgaatgaaaataatttagcttaaacatctaattttacatttaatgagaagcttttataaccacacaaatactctagatctcatttatgacttgtttaggaccacaaatcccaaaagtattaattttttcttaaacttcgtgcccattcaaacaaatttaaatggagggagtaactctattttcatgagtattcaagttaagagaaatcagtggaaacgtacaactaaaagggttttgaggtaataactagaatcatgtgaaggtaatgaggaagaaaataacaagtatctatgatcaaatgtaaagttacagtggaaatcattcagctagaaggctaaaaatgattcagattagatgcttaatactcccttcgttctaatgcatgtgaacctatttgactgggtacagagtttaagaaaaatgaagaccattagaatttgtggttctaaacaagtcaaaagggggctaaagtatttgtgtggttataaaagcttcccatttagtgtagaattgtaaatttaaactaaatagttatcaaatttaggaatgaatcattccttttgaaacggaccaaaaaggaaatagatcacatgaattggaacagaggagatatgataaaaagctttcccaattatagtattctacactagcttttactaattatatgatccgaatttcaactcaaataaaacaaacatgtataagagtcgatttagaactaattaaatggaataaattcataattgaggaacattggcaattgttatactttaggtctaattaatcttatcctcgttataaagaaaaaaaactcatgtttactcttggcatcaaacagaacctactccaaatataatgaatagtaattttaaactataataaatagtgaatatgtggtatatatagtatatttttttcgaagtattctgacacatgaatttcagtagtttacaccatagatgtcacaatctggaattttcaccatcgaaatcgtgatagcgcctaacatttcatttgctagataagccaacattagaacatattattatgatagtttaaaataaaataacgaagaaaaactgaattaactgcaataatccaaagtaataatgcaaaagctaaaacagtcgaacgttaaatacaattctggatctggtatcgcaagtgcacgagctactagaatagtacatacaagggtctgaaataacataaagctgtctgaaaagaaggtacactggtaaatttttagaaaaaaaaataaaaaggagaaggggattccaggagctgcgggcactaagcagctgtatctcaaatcaccgcaagctgtccaatccaagctcactaataccctccactaggaccgaatccaaaatctgcacaagaagtgcagagtgtagtatgattacaaccgaccccatgtgggaataagccttcgtgtatctcgggaacgcgaaggctattagagccgctgctccgcgatcgcttcagacccttcgcgaatacgaagaaggtctgacgcctgtgtattaaaacagacctgaaacgagattattcaaaaaatttaccactcttttattagaacttgacgtaggagcgattttgaagaggggattcaacaccaaatcataggtttgcaatattctttaactcattttcttccatttctaacatcacccattgaatttctaaccctaatctttgttcttccatgatagaaattagggatttaggaattccggatggtgacatacgtcaatgctcccctaaaagtttacccctcattgtatatcttgattttcttgccatccaaagttgacattaattctattcttgtagatgcatgtacttaagaaataagaagtttagcaagtgtatcttttttaatccattaaagtctgatctaaggtaatccaattctttgtatatgtcgaagaataattgaagtggtagtaggaaataatagttgtttagaatttgatatttgtgttttgtcaattgtgtactactgcaacaaggctaaaaatgacaaccctatcgtaatgtgagctgttatttcgtccttttcctatttctccttctaccactcatggcctatcgtgtatcaaatcactcaaatctacgtgtgaggcataaaataaaaatttctggcttttatggattattgtgtgtcggtgtcattagatttagcagcaacaaaattttatttttgaaaatgttgtttgtaatttttggttccataagtgtgacataacttgaagttcaattatggaatttttctaaattcaaaaatctccacataaaaaaactgtttttacttcaaattacttaccaaaactcaaaaatgattccaatttgcatgatcatatccaaacgctaacatgtggccgacaaatacttttataaagtaaagtggggtagctatttttaagagtccggaaccaaaatatggtatttttggactaaaaatacgttaataggtgtaaaaaaacataagttaccaaaatatatataacgccaccctcgtcggcgctatgtcagtgccttttcagacggtgtcagcataacgccaacacccttggcgccatgcctgccagttttcgacacgtcagcataacgccaacggggttggcgctataccctcaatttatcttcttcttcactcagccgaaaaacttggtcccctccccctccaaaaccttttttttcattttaccctttaaaaaaaaagtttcaattttttttgctctttttttctaactctgtatatactgtttcttgaaagtggaaaagagtgttgcatgctcttatcttgtacacatacacacacttacttttcttcttctctgtatattttggttgattcttttgcagctttttgagactctctgaaaaattttacagctaaagaaaaaaagcagaaggggggaaagctaagttaacacgaaatcgtacaaacaattgtgaggaagaaagtcaggaatttaataaaaggaataaagaaatggaaaacgtacaatggttgcttgctttcatacaatactactacagtgtgcagacataaataactgaacctatactatgcaaacgaggacttaataaactaagtactcttttaaatattaaaaaataaataatgtcgtagttgaataaagagatcataggagtaataaatgtatatggtcttcttttttcctttttttttaaaataaagaaatggagttttggagggggaggggaccaagtttttcggctgagtgaagaaaagataaattgagggtatagcgccaactccgttggcgttatgctgacgtgtcaaaaactggcaggcttgacgtcaagggtgttggcgttatgctgacaccgtctgaaaaggcactgacatagcgccaacgagggtggcgttatatatatttcggtaacttatgtttttttacacctattaacgtatttttagtccaaaaataccatattttggttccggttaatatagtaaagctgaaaaggatatgattccctttttgatggtgatctttgggtaaaaatggcgtgtagtagccactaattaagggtgtctttaatttttatccactaattataatgctcaacgaaaatagccactactaatagaaaaaagacaattttaccctttcttcttctctttcgcgttgcattttcatctggaatatccaatgcgattttcacggtcggcctcctccatgcttggtcaataggactttatgtccttaactttgagtttcaggttcaaaagttaaggacaaacagtccttaacttataatttcaagttcaaaacttaaggacagacagtccttaagttattgtttcaagttcaaaacttaaggacagacagtccttaactttgagtttaaagttcaaaagttaaggacagacagtccttaacttacagttacacgttcaaaagttaaggacagacagtccttaacttacagttacacgttcaaaagttaaggacaagcagtatttaaccttgaagtccttaacttagagttccaagttcaaaagttaaggacatgtagtcctgaagtcctgaacttagagtttcaagttcaaaagttaaggacatgtagtcctgaagtcttgaagtttaggacatgagcagaagggtattttcgtcggaccagttaaagtttattaaaccagtggctaaaaactaaagacatttaaaacgctggctttaaaataaagacatgagccgttagtggctatctgtgcacatcgcccgatctttggccgataatcccttccaaagggattttttcttatctataccatatatgaaaccttattaccaaaaatgtgcatatttgataaattacccgtcctgtgcactatttttagacccttaattaagtatggtataggattggtaatttggtatacgggtttataattaaaccaaaccttaaacattgagggtaataaggtttcaaatatggcataagaatataaaaatcccaattcgaaaaccaagtgtgtcctggcctaagaactctatatacaaataggtttgtaagatcattgataaaggtcgtggcctaagaatttaatggaagagtttaatataatcttcttcttagcactgattactaaaccgtttcttttaacaactttatgcttaaaatgggaatcaatatcgaacatcatctatcaatataaacaatagacatatgactataatcattgaaaatggaagttcatgatattttgaaagtcagacggggcatttttaagcccaaaaagcaaaatattccattcatttgaataggtcttgctttagagagatgacctgttcattgaattcttcaagtaaaggcagtaggaaaatcggagcatgcatatttcttttttcaaattgcgacatcttaatgttacaccccatattttcgtacatgaaacatacgccataaataaattaatgagagcccgaaagtgagatgttacgtcccatagtattatactacgataattctacgcttcgcagtatcaaattaagacgatgttgcaccctaaagtattatatgttaaattggtcataaggtaattgatatcagttcaagtaaaagattatttggaaattgtaagaattatgctatttcacaagtgattagtaaaggtgtgagggggaagcaagtcaaagaaaataaattttcgtccaagttggcgtattgggataaaatacggcccgagctaaaatactcggtatttatggactagtgtcctacgaggtaccacatgaccatgatagtaaggtgtatgaggtatgtgaaaagtgagtagtattttaagaatttgagataattcttaattatgtgaataattaattaatggtagagataattattgtactaagtggataagggtatttttgggactactacatggcatgagctaagccatagtggtaaattatacaagatgagtcataagatattgattaccttgtttacacgtaagattcttagtctctttattggtaaggtatcgaaaggaaaccacaaccaagtggaaggactttctgaagcatgtagtaaagtccttactacaaaagactaggaaaaccattgtcaactattactacaatgtttttgttcccggcaattcagcgtacagaataggtaatccagtaacttagtcaatattagtgtgattttgctgataacattaaggacacaaacatgcataaaggaagtgaaggccagagacctgagggtttgaaaagtcgatacctatgttggcaaatttagtccctggaagtagacaatctaaaaggttattttcctcctttcaggatgtttgataggagtgaacctttcgatacaagtatgatactttaaccatattaatatcggttcagtgaagatcatttgttcagaacaaaaagatccaacgtgaaatgctaattcaaagaaagcccggtacaatctttctcaagaatatcatacgaatttttcctacttcaggtatgttaaggctatcccttctttcttttggcatgatccatacgatacgaacaaaacgtgcaaatgcacaaattccatatatgactctattcatagaagtattagaagtgcctatgttcttgaattttcatatgtattattattccatcgtctgttcatgggtctcagaaaatacgtaaaatgatgttatgatattaatcagagatataatggtcttatgacgtatcgagagattttgttattgtatttcatatgcatttcatgcatctatacatgtacattgacccatgactcagacggcgttatatacgcatatatatgtatatatatatatgtatatggaacatgggaaaaggttacggcgttatatacgcaccaccacctgatcagctggtatatgatgatgatgttgcccacagtggctgaaatatgattcaaacggcgttatatacgcatatacgggtatgtattcaaatggcgttatatacgcatatatatatatatatatgtaagtattcaaacggcgttatatacgcgtatatgtatatgtgtgtgtgtgtgtgtgtgtgtatatatatatatatatatatatatatgtatatgggatatgggaaaggttatggcattatatacgcaccaccacctgatcagctggtatacgatgatgattttgcctacagtggcctatgtgatatgatgggatgctctcagaggccatgatgttatgaaacatgtgcctatgcacgacatgacattcatacgcatatgcatgacgctaaaggtaatttatgatttataaagttattcagacttacaggttgagttatgtactctatatttcttccatgtcttgtatgtatctgtttatgtgccttacatactcggtatattattcgtaccgatatcccttttgcctggggacgctgcgtttcatgcccgcaggtcctgatggacaggtcgagagcccttcaagtaggctatcagctcaacggaagatcttggtacgctccatttgcttcggagttgcgtatttggttaatatgatttagacgtctattgttggttggcggaactctgtcctgacctttgtgacacttatgtacttttagaggcttgtagacatatgtcttgtatgtgaaagattttacggccttgtcggccgatgtcttaagtttatgaataatcatgttggcctattagagccgtatgtcatgtgtatatgatagtgtaataagaaagatacgttacattggtacttggttgagtaagataccgggtgcccgtcgcggcccatcggtttgggtcgtgacaaaagtggtatcagagcagttctgtcctagggagtctacaagccgtgtctagtagagtcttgtttatgggtgtgtcgtgcaccacacttataagcaggaggctatagggcatttaagattgtcactctttcttcttactctatatcgtgtggtagagctcacatataagaattcaaattccgaaattctattttattcgtaataagacgatatatacttccagaaagaaggctggaaagagagagagttgtggaagagttgagtcagaggaattatatttttgtataatgcctacaataattaaatgtgaggtctttagcagatcatgagtatattaaaaggtgtaagcttcctgataagaatccataaggaaagaatgtctatccatctttatggtaaaagacaatgagagattaagaagctaaatacaagtttcaacaagcaaaagaagtaagatgaagaaggatacgaggcacccaattaatgaaggctaatggcgtttataattaaggcatagaaacataagctttttgagttatattcaatagtaacagaggtatatataattggtcataccccttccagatatgccctatgggggttaacaaaagtagtataagaagatatgatggatgaattgattgcgtcagttggcatttccaaaggatattgcaaatgtgctaatagatctctttatgagacacttagatggtgcattctaaaatagtgcagccatatatgagtactacaaagatatgcactataagccttaaaggataaatattaccttagtgtggctcgcgtccctagtaaagcgaggaagttaagcaacttgaagagccactggatggagcaaaggaaaactaaaagcgaaagaatatcgtattaaagttttcacaagaaaagggatatgcaaaaatattagtagagtaatgagaagagaaataagaaagaattacgaataaggtgtgatacatggatgaaaatggtagagtgttaccgaacctatagtcaaatgaaggaagagacgaaaggtgatgggccttaagaaaacaaaataatataggccataaggttatatctttattttgagaaataagttcttgactccaacgtgactaccaaaaggaaaagttagaccccagaataatagaaccagtatggattagtgaacaagataaactaaacatgaattagggactgaggaactgatgatagtcgccatcataagaatttcatattttgttccaccaataatagaatggacgacaaaagaagattcatgagaaattcagagaatagtcattcaggaagacgcttccctacagcaagcaatgagagcaacgtccagcttaagggactgtatgtgccagttatactaagtttcaccctcgtgagtaaggaattttgctatccttggtacggaaggattacaacaaggcgagtaagggtcatcgatgatgtaaaaggatgccaaagatgaaaaggtgaaacatctacaggaaggtcatcgtagctccaaatattagtattactcccctaaaggggggaatatggaatgataaaaggaagaatacgataaaaaagagaaagggatgagattgcacttacccaaatgctacagatatgcgaagattccagaatattatgcaagcctgacgtcaaggaaaataagtaagggttcctgcctgatatgttattgacaattaaggagccaatgcgagacgtaagttaagaccaaggaaataacccaagaaagattaagaggaatattaatgtgataatgggccaacgagtagttagtagttggtcaggaagatcccagttatggctaaacacgaagttacatacgagtcatctgatcatgtaagataaacatagtagaacccaacatggagaattcagcctcggagaatatcgttataatacttaagatatattcaaacaagagtcggggtagataaaggtaccgtatgagtgttacgagataaaagaaagtgccactaggaagacattcaaaatatcagttcagaagcaaccatacaagcacaaggacatgaaagtaagcaactatagatgattatagtcaagtaaggacataaaaaaaaagagggtccgtaataagctcgcatctttacaagagtcagagggccttccctaagtactacaacgaaagactagctgaggagataagaaagaaggcttcaacttaagcacaacgacctaaagaggaaatggtcgtgtaacaataatctcgcaacaacattgtaagcattctaaaggaaagtggcacctaccgtggctaatgaacgagaagtaagaatcaaaagtaatattcgagatcatatgagttgtatgaaaactctggcaagtgggggcactaagataagttaactatgcatgcaacaagggggcagaaagacctggaaaagtaatagcttaagttgaaagaaaactaggatggaacgaaagaattatttgaccaatgatccagagttagtacgttatggatacactcgagattttggagcatatctaggcaacatatttgttgacaatcatacagccatagaatactccggtataagttaaaagaaacaattgagtccagggcatagacaaaggattgaattactaggagattgtatcatggatattccataacgcccatgaaaagctaaggtaataactaataccatgagccacagatccgataatagcttaagcctacgtaaacgctgatcggaaggaagagaaagtaaagaattacatcacttacgtaaatcaggagtctgattattggacctagaaaaaattatagaagttgttcttgagaacatgacagaatcactcttaatatcagatgttcaagagaaataacacaacaaccataatctataatggctctacaaggaagccagttcgaagaagtaccagcctcataagaagtcagtatgaagctctaataataggtgaatttaactatattcaggccctaaataaccaccttcttgcatagttttggtaacgaaagtgataacaaaatgctcttatgagtgcttttcatgattttcaggattaaatatgactagggaaggcgaggagtacttttggattcaaaaataaaggaaaagaggccaaccgtgaaaattcccaagtaaaccaagcgaaaaaaggttgaggattcaaaaaatttgaactgccaccgctccaccgcaaccgcggcagaaccgcggtgaaagcaggctgcagaagtttgaagattcagaggggtcgattgaccgcggttctaccgcgatcgcggcagaaccgcggtaggcgtgctgaagctcaggggcaaaattgtccatgcgtgatttttagccctaaacctattttagtcactaggtttcgcccattggaggcatgcattgagtttttagagttctttgaaggaaaaacaattgtgagagaatacccaaaccatatttcttcttttcctttgatttttgttgttagtttatgatggatcttaatttagtttgtttacccatagccaagagtagctaaattccttgtctaaggttttgatggaacctattgggggatgaacttcttgtttatgtgaatacaaatttttagtttcaatctttatttattcaactgtgttcttgttatagttaattgacaggatcctcaattagctgtgtctatttagtgtgcataactcagaagagagtgcatatttaggttgttgttgaataacaccactcctaaaatataagaggaatctataactgcgggtttaaaggccggattagggataatgaagccttgggtgcaatcttaagtgaactgtgttaattaaagctagctagtgtatctcgggagagtgcaatagtatactactatgattactcgggagagatccatggtaaggcgagcattcatgattgatagaggtgtgttggtaaatttgtatgaagcataaacaaaagggattccatcaataggggaaatcattaccttagcttttctctcgtcattgtttacaaccttagttagttaagttacagcttgttattttactacaatcttagttcgtaaagaaacctccaactttgattcaaaagtttggggaagctggttctgaagagtttagtgggtctaaagatagtggttgataggttaactctctgtggattagaccctgggcgtaatactcgggttatatttgcaacgtccgcagagtcctttttagagggcatagttgggcgtgatcaaattttggcgctgttgccggggagttaacggaattataaattgccattgctagagttacaaaaattcttggtgtagctagtttctttacacccaatttttgactgaaacttttgacggttgacttggttgcacaggtgtatgcctagaaactctacaaggactggagaactacttgaaggactctcagaccctgagaaaatattccgggtgtctaaccgtgccaacaaaagacttcaaccacctcaacagacagacaaactctaaactgatatggaaaatgcagacgaccccaacggagacggcaggaaccaacaagatggcttaaatgccagagtggtggcacctcctgtgccggagggtgcactatatgactaggcacaaccgacatctgacaatttggcaactgccattgttgtgcctgcgatacaagctgaatcgttccagattacaaacaatatgctgcacttgttgcgaaacaagggactcttttctgggacgcaagtagaagatcctcagcagcacttgaagaatttcctgtctatatgcaaaactcagaggtagcctaacgtgactccggaagcaatcaggctgctattatttcccttctcagtgacaggagctgctcaggtttggctaaactcactccccataaattccattgaaacttgggatgagttagtcaagcagtttcacaacaagttccatccgcccaacaaaatagctcagcaaattgatgagatcgtgagctttaaatagaaaccaatggaaacattgcatgagacatggggcaggttcaaaggaatgttggtgatgtgtccccatcatggtgttccagagcagatgttgggacaacgtttttacatgggactttctgatagtatgaagaatattgtgaatgcctcagctggtggggcattcttgagcaagacctggagagaagggcagaatctgctcgataaaatggctcagaattcagggtggacgaccaggaatgcacctatcactctggtggtgcactcagtgcctctcgatccctccaacactatggttgagaatatggcgactcttttgacacagatgagcatcctcaccaaaaaggtggaggagtcagggcaaaaatagcaggtacatatagtagatactaccaatgggggcttgtgcacatcttgcattagtcagccaattggtaatccatggaatgtagagcatgatcatcatcatcagcaccctgaagatatgaattatgtggctaactatgggggtcagaggcaaggaaatcagaactggggtcagcagactcagcagtagtacaggccgccccagccacagtacaatgtcgggaacataggaggtatgagaccccccaacaacatggcaccctatcctagaccgcaggggtacaataatcagtagcaagggtaccacctacctcagcagcagcatggtgggagacaagaatgggttcgctagactggaagcgatgatgcagcaggtgattgggtccaatgcaaagataaatgaaagagtagatgcacatgacgcagctattaaaaatattgaagtgcaagtgggccaaatttctatgtctctgaacaatcgtcctcaagggacgctacctgcagatacccaaatcattcctaaggatcagggcccgaagcagctgatggcggtgagtttgcgtaatggtagagatcttgatgtagaacatgagagagctcgagaaaatatacaagccgagacactcattcaggtgcccattgagctggatgaatctacaaggctgatagatgtgacagtccagcctgctcaggaagaacagaatattcaacagggaactgagaaagttggcgaaacagttgaagagccgatggtggaggtagtagctgagaaagaaaagtcccaagtgattgggaagaaaagacctcctacacgatttccacagagattggccaagcatcaaaaggaagagcagtacaaaaagttctttgagatgctcaagcaaattcaggtaaatattccactaatcgaagctttaaaggagatacctggatacgcaaaaatgatgaaagactttatgtcccggaagtttgacttccaagacttggccatggtaacacttacgcagacctgtagtgcagtggtaaccagacttgttgctgaaaagctctctgatccagggagctttactatttcatgcactattggaaactttgcctttgcaaaggcactctgtgatttaggggccagcattaatcttatgcccctggttatttacaagaggttgggcattgggagagctagacccacatctatgttattgcagctggctgacatgactgtgaatcgtccatttgggatcctcgatgatgtgcttcttcaggtggggaaattcgtgttccctgcagattttgtgatcttagattgcaaagtggatgaataaattcctatcattttaggaagaccgttcttggccacagggagagccctgattggttatgagactggggagcttaagatgaggctcaatgacgaggagattatattcaatgtgcagaaatctatgaggcgaccaagtgagttcaccaattgctctctaattgatgccgtggatgtgatcgtacaatctgatgatgaagtgttgacggttgaggatcccctggctacatgtctgacgaatttggaggaagtgaatggtgaggatttggcggaataggtgttggctttggaaggtagagggtttttgggatagaaatctagagtttgagccctacacttagagaagagagagactcctccagctaagtcatccattgaagaaccaccgaagctggaactaaagccatttccaacccacctaaggtatgaatttctgggacctgactccactctacctgttattatctcatctggtttgttagatgtgcaggtccaacagcttttacaggtattgaaggaatgcaaaactgccattgagtggaccatggcagacatcaaagggatcagctccgcttactgtatgcacaaaattctgctggaagaggggcacaaaccttccagggaacatcagaggaggctgaacccgaatataaaggaagtggtgaagaaggaggtgataaagtggttggatgcgggaattattttcccaatctctgacagcagctaggttagcccagttcaatgtgtgccaaagaagggtggcatgatggttgtgaagaacgacaataatgaactgatctcaacgtgaaccatcaccagctggagaatatgcatggattatcgaaagttgaatctagccacccggaaagaccacttcccacttcccttcattgatcagatgctggatagattggcagggaggtcacacttctgctttctcgatgggtactcagggtacaaccagatttccattgcacctgaggaccgtgagaagacctccttcacattcccttatggcatttatgccttcaggagggtgccctttggcctatgcaatgcacccgccacattccaacggtgcatgatggccatattcactgacatagttgaagatataatggaggtgttcatggatgacttctcagtggtggggaactcgtttgatgagtgcctagtgaatctaacgcgtgtgctaaaacggtgcatcgagactaatctggtgttgaactgggagaagtgtcatttcatggtacaagaaggtatagtcttggggaaccgggtgtcaagcaagggaatagaggtagatcgagcaaaggttgatgtcatagcaaagctgcctccgccaacttcggtcaaagcaatcagaagttttcttggacatgccgatttctaccggcggttcataaaagacttctccaaaatcgccaaccctctctgtaagttattagagaaagatcacccgtttgtattttttgatgcttgcagggtagcatttgaggagttgaaacagaggctggtcacagcacccatcattgttgcccccaactgggagcaaccgttcgaattaatgtgtgatgcaagtgactacgcagtgggggtagtgttgggccagtggaaggaaaaattgatgcatccaatctactatgccagtagaatgctgagtggggcccagctgaactatacggtgactgaaaaggagatgctagctgtgatgttcgcattcgacaagttccggtcctacctgataggatcgaaggtaattgtatacactgaccatgcagctcttagatacttaatagaaaagaaagactctaagccacgcctgattcgttgggtgttgctgctgcaagagttcgatcttgaaatacgtgaccgaaagggcactgagaatcaagtcgctgatcatctatcacgacttgagggagctaaatacacaattgaggttgaggacattcttgaaacttttcaagacgagcaactgctcgccaccactcactaggaagcgccatggtatgcggactttgccaattacctggccagtggtatagttcctcacgacctttcatcggtccagaggaaatgattctttcgtgaaagccgtttgtactattgggatgaaccctatctctttataatatgcctggataacatgatccagagatgtgtctccgagatagaacaatcttctattttgtaggcttgtcatgcatcgacttatggtggacactttggagggattagaacagcagcaaaggtgctagaggctggatttttctggccaactgtgtttaaagatgctcactcatgggtgaagggttgtaacgaatgtcaacgcaccgggaacatttcccggcgccacgagatgcccatgaacccaattcaggaggttgaagtgttcgatgtctgggggatagatttcatgggtcccttcgtcagctcttatggcaataagtacattcttgttgctgtagactatgtgtccaagtgggtggaagctgcagcattacccaccagtgatgcaaaagtggtggtggggtttctaaagaagaacatattcacccgctttgggacgccacgtgcaattatcagtgacgggggcacttacttctacaacagagcattcgagaagttgttgacaaaatacgacgtgcgccataagatggctactccttatcacccgcagactagtggacaggttgaagtatccaatagagagataaagagtgtgctaacaaaaactgtgaacgccaaaagaactgattgagcgagaaaactagatgatgcactctgggcttaaagaacagccttcaagacaccaattggtatgtcaccatacaagttggtgtttgggaaggcttgtcacctacttgtagaacttgagcataaagcatggtgggcactgaaacagctaaacttagacatggaagctgggggcacgtcaagagtcacagaattgcatgagcttgaggagttccgacatcttgcttttgagagcacaaggctgtacaaagagagaatgaagaggctacatgattagaacattgctgagcgaaatttcaaacctggggacagggtattgctatacaactcaagacagaggttgttcccgggtaagctgaagtcacgatggtttggtccatttcgggtagtcgaagttttcccatttggagctgttgaagttgctactgagaatgactctcgcacatttagagtcaatggtcagcgtttgaagttgtatgtgggcttgagcgagcctaaggaagggtctgagctgcatttgaacgaaccacagaggtcgagcgagccttaattgcgctcatctgagtcgtgccgcgacattaaatcaggcgctgcatgggaggcaacccatgaaattgttgtaagtgtactcttattaaaaggcgaccgcggtcaaaatgcggtccggaggggtctctgaaccccggccatcgcggttgtaccgcgatcgcggccaaaccgcggtcccaaaccctttctgaatctcatctaccgcggtcctaccgcgaccgcggtacaaccgcggcgaccgcgttccggatcaggcatgttttctttttaatttttaattcattttttacaccctttttacccataatacccccacctacccctttacccttccccatcagccccaaaccagaatcccaatgcccccaaaaaatctctcttctctatcttctctcttcttttctacacaaattccttcccttctccaaaaaccccattgtcacccctacaataacctccatccccacttcccatacaccctcttttctattcaagtaagtttttttcttctctcttttctattttcttcttatttgtgtagtataatgtagttgttgctaaattaactaaaccctagtatagtgtagttgttgctaaatagtgtaatatttttacctttttgtttcttgtatgtttttgttgttgtaattgattatgtgaacttgtttggtactaaatggagtgggtcttcatgatattttcattgcgggggttgtttgaatgtgttggaggcctaaaaattaattgtgtaatgtagtttggtgaaggggctaggtgtggccaaaaattgggggtttgtttgtgctatgttgaggcatttttgtacctactctaggttgtgatgatgttgcttttggtgtatggtggtgttgtaattgtttgaaactatgtgaaggagtgagtgtggggtggtataggccgaatgttgtaagtagtatgctgtgaggcctttgtggaggttgtgaactttgctaccctgctaggggggctagtttgcaaagatgaactaaaaagggggtgttgttttggttccatcgggtggcgaagtctgagtaaccacccgtttggcactagctcggatgaatttgatggtttctatgaactctctgcaggtactatggctcgcaagcgacaaaggagaggggcaggcacatctcaactgcccacatacgatgagtcccgatttgtctccgaattagcggaggacgattttaacgccaaggctgggaagaacttcattcaggagattcaaattgaccggcaagccctccgcggggaacaggaggaaatgtatgaagaaattcggaggcagggaatggaattcctctttgatgtcccctgcccagtgaaccgaatgattgttagggagttctatgcaaactgcccggcaagcttaggtagagatgtgtttgtgaggggtatgatagtcccggcccacgttccatatattcgccaggcattgaggttgcctgagttcacgggcgatattaactactaccacgccaggctggatgtcacgtgggaggttatgactgaggtactttgtgctggggggcaaccaacatggatcaaagaccacatcaccctgaactccaactctttcacgcacttggccaagtgatggttgactgtcatctgcagcaggttcatgccttctagcaacaccactgacgtgaacttcaacaaagccctattgacatggtgcttcgtgactcagaaagagtttgatgcagcacatgtaattggtaatgaactgttcctgcggggaccgctactgtcaaaggggttttactgccccttcttggtgactgcactatgcttgcggagtaatgtcccaaccaatcctactgatgggacagtggcacctgaagcaccattccaggcttcacgcatctgagtgggccggggtgctcgcactacattgtgatagatgttgaggatgatgacccagtccctcctgcaccgtccaggcgatctactgacagcgccggaccatctcggcgcccccatactggggcaggcctatccagatctcagtctacccagcctatgctgcgttccctggaggaagaggttgcggatctccgcacctccttagatggcctacatacacggatggatcccatgtctcagaggcaggcccggtccgagggacggttcatgtcctggtttcaagctttggggagagcatgccatgtggaccccagcaccgtctccgactctgagtgagtctcagggaagtcttcttacccttctactttgtactttattgatatggcatggggacatgccatgattttaagtgtggggtgggagacttgctctggttatgtgttgtactgtacattgtgactgttgtagcattagattgatgtgttgtatataactgatttaggtatattaggagtaactgacttggcccaaggacggacacttgttgtggtctcttgagggtccaagtcggatacataaaaaaaactgaaaaacaaaaaaacaaagttagggactcttcctgaggacggaccacttggacagtactcttgagggaagtagtccatgtagatatttttatttcttttattttgcctttttaggtagtgtagaaattcccccttggtttttcttttgaccacggttcttttccaagggttttcttgaaccgggttaggtagattttccttttgtagttttaggactaagatgggtgaaggcaagaatgcgacccttgatggtcacacctacaaacaactaaaatgaacttgaaagtgtgatgtctaggctcagttgtggacttgtaaatctatgccttaagtttgcacatcctgtcttgcttgaacgctcgtatgtgtgtgttgataaactgattttgaatgagttacatgctgagtgtgtgtgagatttttacttgcattttgtgcttgcatgcgatacctagaacttgccatgtgtgtttgcaaagcgaaatagaagctgttaggtcttagagatgattgaggcatttccttgtgtaaacctgttcaattgtgaaaccacttgtatatattgccatagttaaccccgttgagcctaaagcatgttctttgataaccctataatgacctatatcccagtgtttaaataactcattgtttgaatctatacctcctagaagcacttaaatcacgaaagaatatacaaaagtcaaagtgtggggtggtagggagttagcgaaaaaaggaaaaatcatgaatgaatagttgaatggtgcactggttttttagaaaaaataaagtgaaacaaagaaaacaaaacaaaataaagaaagaaaagaaaagaagaaaagagagaaaacaagaagccagttgcacctaaagaaaagtgggggttacatgtggaacaaaaaaatgtggaggaatgattgggctgagcatggaaactgataaaaaaaagtatgtattaaaagtgcttagggaggttagtcactacatccaaatgtatcctacccgtcccttagcctacattacaaccaaataaagacctcttgatctttgactaaaacagctcgattagtagagtactacactaggggtaagcttatggtgtgtctgtgtggcatatgaatgctctttactgagagtgagtgaattctttctatctttggttccttgtgtttgaatgttatgtgtgtggaacttctctcagtcttttgatgtgagggcatgtgactcaagaagaaaaagtaagtcttcacctctgttagagtaactagagtgagcttgagtgtgtcatggtagtagagtctgcatcttgggtatgactgttgcactgcttaggttggttcgtcaaaatggcgagtgtgacataactttgggtaatgcagcaaacggttaggcctagaagtgtggtttagcttgctcgaggacgagcaaaggtttaagtgtggggtgttgataataggtgaatttaactatattcaggccctaaataaccaccttcttgcatagttttggtaacgaaagtgataacaaaatgctcttatgagtgcttttcatgattttcaggattaaatatgactagagaaggcgaggagtacttttggagtcaaaaataagaaaaagaggccaaccgtgaaaatccctaagtaaaccaagcgaaaaaaggttgaggattcaaaaaatttgaactgccgcggttccaccgcaaccgcggcagaaccgcggtgaaagcaggctgcagaagtttgaagattcagaggggtcgattgaccgcggttctactgcgatcgtggcagaaccgcggtaggcgtgctgaagctcaggggcaaaattgtccaagcatgatttttagccctaaacatattttagtcactaggtttcgcccattggaggcatgtattgattttttgagttctttgaaggaaaaccaattgtgagagaatacccaaaccatatttcttcttttcctttgatttttattgttagtttatgatggatcttaatttagtttgtttacccatagccatgagtagctaaattccttgtctaaggttttgatggaacctattgggggatgaacttcttgtttatgtgaatacaaattgctagtttcaatctttatttattcaattgtgttcttgttgtagttaattgacaggatcctcaattagttgtgcctatttagtgtgcataactcggaagagagtgcatatttaggttgttgttgaataacaccactcctaaagtataagaggaatctataactgcgggtttaaaggcggaattagggataacgaagccttgggtgcaatcttaagtgaactgtattaattaaagctagctagtgtatctcgggagagtgcaataatatattactgtaattactcgggagagattcacggtaaggagagcgttcatgattgatagagatgtgttggtaaatttgtatgaagcataaacagaagggattccatcaataggggaaatcattaccttagcttttctctcgtcattgtttacaaccttagttagttaagttacagcttgttattttactgcaatcttatttcgtaaagaaacctccaactgtgattcaaaagtttggggaagctggttctgaagagtttagtgggtctaaagatagtggttgataggttaactctctgtagattcgaccctaggcgtaatactcgggttatatttgcaacgtccgcagagtccttttcataaggcatagttgggcgtgatcaaattttggcgccgttgccggggagttaacggaattatcaattaccattgatagaaatacaaaaattcttagtgtggtcagttttctctatacccaacttgtgaatatttgtgtaattaatttttcttaccttagtctattttttgtttgggtcttgtttattttcttagttttgaaaaatggcatcatataataaaaattggtaggatggtagttgttcatactgtgatgacccttgtctttattgtggaggaccacactcgtggcaaaattgtttaaattctcccgggggtggattgtgcgcacaatctcaaacccatgagtggagtattcgtgataagtgtagttttcaaaatggtcattgggatgattgtgttgattcgtccttcccttccccaagcccccgctatgatgattctattgtttttgatgaaaatgatagggctaacgaattggaagaagttgagcatggccgaaagggagagttcaagctcatgttggagtgcttacttgaaggaggaaacaaagaacaaagtgccttggaggagcttttggaaaatagtctccaaaattccttggcacttaatcaaaaccaagaactctcaaatgcccaaaatgagaaaataatgctcatgttggagaccattcttgaaaatgaggaagaatgtgagctaaaatttgaagaatcaagaattgaacctccgccaaccgaccccatgagtaccaatgatgccgagaaaaacatggacttagagtcaaccggtgtaaataaaaatatggttgagaatgactctagtccgggggaagaagaggatgtcaaaatagaaaaattgcaaaatgaaggtttgaagtcacattccaagcatttttcaacattggattgtgtagtgatataaaaattgaactacatgagtccgtgagggactgcgaggaggaaagggaacaaccatacattttacactttgaggaaacaagaaaccaaaatggcattcctcacatgagagccaagaagagcaaaatgaagaatttaaggctcgactcgataatcaacttaccaccccctgccgctcgtggtcacaagcttgattccaagctagatgcacagttcatatcgtccaagtggcgagaaaagtggtaaaattatttgcgtcgtgccgcgactttaaatcaagcgcttgttgggaggcaacccagctttattgctttcttttatttatttattttatttatttttaattgtattatttttgtagtgtcaatttttattttctaggagcatggaaagcaaaggtattggaggaccaagcttgggagaagtctgagtaccccatgagctgttagtgcttcggcctttggcctaccagggagtctcttttacccttttattagttatggtgtgcattggggacaatgcacaattttaagtgtggggtgaggagattgtctggatgactttctatgctattttagttgtgttagtttaattgaataatttttttttaaatagaaaagattggaattttcccgatgatggatctattagacaattttcttgaggaatttaagtctaaaaaaaaggattttcttttgttaggtagtgtagcaattcctccttggtttttctttaaaccacggttctttttcaagggttttgtttgaaccaggttgtgacgacccgacccgtcgtctcatgcgataccgtcctgtttttcctgttttatgcttccccgtgtttcattgtatgtgtttggtgagtttgaagtatttcggattgagtttggttagaaatgaggcaaatagtctctttaaggaaggcttaagttggaaaagtcaaccggacgttgacttgtgagttagagggcttggaatggatttctgatgattcgactagtttcgagggaggatttctgacttaggagagtaatcagaagtgaattcggaggctcggtgtagaagttagcctattttggcgaagttaggattttggcgaaatccgattcgtatgcaagattttgatccaagggtcggaatggaatttcgagaatttcagtagctccgttaggtgattttggatatgtgtgcaaaatttcaggtcattcggacttcgtttggttgggtttggaatcgaatgcgaatttggagagttttagtttaacttaggcttggatttgaggaatttggtgatttttgatgttaatgatagtgtttttatggcttgagcaagtttgaataaggtaataggtcatgtttgtgcttttggttgaggtcccgggggcctcggggtgatttcggatggttaaacgaaaggtttccggactttgtggactgctggttttcagctgttgctgttgcagagattttgctctatgcgatcgcaggggtgcaatgcgatcgcatagagggtttgaggggggtctcctggtagtgctatgcgaacgcaggggcatggtgcgttcgcatagaaggtttggaggggatgttgaatttgttcaatgcgatcgcgtagaacgagttgcgatcgcagggcatatgttgcgatcgcatagggtattttgaggactggaaattttatgttatgcgatcgcaaaggttgtgacgcgatcgcatagaaggtttcactgtagcggacagaagggtttaaaacatttcctccgcgagtttaagtcatttttccaccattgttgaggattttgagagcttttgggagcaaatgaagagggtttcgaagggaatcaaagggaggtaagttccttggcctaattattcaagtttatggaagaattaacatggaaattggttgaattcattaaaaggggctaaagttagggcttgagttttgatattttaaattggaacttgataggccatttgaactcggatttgggagttcttggtaggtatggactcgtggcgagacgaggaatccggtaatgtgagttttgtaattttttcgagaagcgggcccagggctcgagttttgctagtttcgagatttttgctatttctcgattgttttcgattgggtgttgtcccattggcatattgtgatgcattcgctctgtttttgtttagattcgacgcgggaggaagccgaattgagaggcaaaggcgtcgcgagcttgagacttcgccggttcgaggtgagtagtttgcatagatgatgacctgagggtttgaaaccccggtatatcacactgtgacactatattgaggcgagacacgcactctatggcaagtgcggggtcatttatgtttgggaattgtgactcggtccaccccgagggagaattatactatattggcgactgatttgcaccctgtattgatgatatctgggtttgatgccatgtttggggccttgtgccagcttgtagaatccttcagggattgatattacagaattagcatgatttgcatattatttgacctcagtcctgagtttaaaacactgttttgacatgcttagtcacgtttctaaaattttaataacttgatcatgatttcctaataattggaactgggctttataaaaatgaaactgttgtgtgactttcatgcatagtctggactgagtatggatcgggttgcacgccgcagcgatgttattatgatatggcgcttgggctgtaggagcccctccggagtctgaacccccacagtgagcgcgggtacccaaatggatcgggctgcacgacgcagtgttcaagtgcattgcattgcattcatgcatttgcattcttttgatatatcggaggttgttctgttgctattatatcgttaattgtgtagaactgttagtttagctttactttgtggcatttcgtggatttctcaccttcgggtattatatatgcattttactcactgagttggtagtactcaccccctactccctgcaccttgtgtgcagattcaggtgttccggaggcttagctgagctaccgccgtctccccgagtgtttcagagtttgttgaggtagctgcctggcgtccgcaggacctgactacacattttgtctcagcttctctttatttacacattcagacttatgtatttactttagatgttgttattcagtctattttagaggctctatactcgtgaccccaggtcttttgggaatgtttatcagttgtttcgttttctttcgtattgctatttctacaaatattagagtattattctaaaactgctaccttttcccctaaattgtcaaatgttgggttgtattactgtgttgttagaaattgttggtcaggcttgcctagccttacggttggacgccatcacgacctggtttgggtcgtgacaagtttgtatcatagcctaggttactaggcctcacgagttatgagctggtatagtagagtctcgcggatcggtacgtagacgtccgtatctatcttcgggaggctatagaacctttaggaaaacttcacatttttggaattcttatcgtgcgtacttgattcagcttgggatatgactcttgaaataccttccttacgtttgtatgcgcccgtgagcactcaatattatatgcgccttgatggcttataatccccgatcgaggggcgagatgtgattgctatgagttgatgtgggctaatctggaggacttgaggccgaatctccgtctatagcttgagcaccaaggtgctgattgcgcgagctagtgttaagagcttataagttcagtattgtccctaattgtgataatggcggctggatagctacgtgatgagtatgttggtgtcgtgcgatgtgtctatatgacttggaagtgtcgaagaaggtctgctaggtgatagacgaaccattaagtgtttgatttccattgcgatcggatgtgttgccccgagtcatgggtgcgtggtgaatcttttcagttctcctagttgggagcgaagtaaatagcacgttgcgggttgagttcggacccaggaagattaaatgaccatgtaacgtatatgatggtggaaggcaggctgaaatactaaattgcggcgaagcaggtgggatatctcctgcggagtgtccttaagtggtatgatccttacgtgtatgttagaagatctcatgtgtaattgaaaggtatcttctatgtgttatgattcgaataggcgcaacgcatgtccatgcatcaattttgataatataatacatgtagtattgagattaatgttgttgatatacattgtgatgctctgtcaagttgtgaacgtgttgttaggatggttttggtgattctctggcaggtggataggctcaagtacaaaggaaactctgccaaaaattttaaaaaaaattgggacttagtaaaaaaaaatcgcctaaagagtggccttaacggttgtgtgaatgaatgcaagaattgcagaagagttagaatttctgatgattcgtgtttccacaagcttatgaaagagtgagtttaatcccaccatgatattacgacagcaatagagtatatgtgttgtgatatatatggcttcgagctaagttggggaggttgctgttgattagctgatggtacggttatgtactatgttagttccgatttgatgcatgcaggtgaatcagttctggttgcagaaagtgagccgaaggtggcacgagtgcagcaaaattttgccaaaggttatatggtgcttcgtagatgtgagaaaataataggatgtcttgagttgttaataaagaatgcatagtgtaaagagaaggaagttgtttggttgtatcggaatgggatcacatcctgcggtgtcagagtactaataaggcagtggttcgattcgttaagtcgggtaatttgcagtgtgtataagagtggatgacttttgagaatggttttgatgtgttgaagattctatatgtagcactcaggtgttttaaggttgagtatgtgaccaagttagtgttttcattagaacaggtcaagacttgtggtatttctacgttaattacgagattctatgtatcagtatttggaaagtaatggtaacgaattcagtgtcgcaggaagttcttcgggtaaagtactctggaatgtggtatttctgagaacgttgagaaagtattcagtggcctatgggtcttagacaacgtggtctggtgtttgggtctcgtatagtgggcctgagttgaagaattgtggtgctacagcaagagggaaatcaagttgaaggcgaatcagaagaaatttggacagatggtgtagcttgataacggaccggattcggcatgttaagggtaaaattaattctcggtatgtattcgaggtgatgggttagcacatgtaatttttgcagcaatgctcttgggttttgacgattttcttagcgtgttttagttaagaggattcagtcacggcggtgtagttgtgaagatgaaattgggagagttcttgttgattaatactatggttgaagaggtgcatttttctacgaatgtgagatggcatgagatgtgtaatgattttattcttaggtgggatcaatggaagatcataaagcccttaggccgtgggaggcctcagataatcaggagaaagggtgctgctatttgaaagtgattcgacgggagtatatgttcagaaaaaggggcagtgtgtttaagcgatggtatttcggtaggatagtattgcggcactttcccgctaaatcgactgctgatatctgagttgtttgatggcatataggagttttagaatatctctcgtggaataattgggtacttgaggtgtaatctatattcgtatggtgtaaattgggatcaggtacagtgattcgtgtgctatgagtagtcggagactgggagttctccggtgcagtctatgtagtggttatggatcgggtgtgttgtattggtactgttagcggctattgggatttggtagccgagtggatctttccttgcttagtatattaaattctgcatatgatattgggatgtaaagtgattgtctcggtgttgggtattctagacgattgtgctatgggttatgttgggaaaataccacaggttgcgtggcgaggtgtatcgggctatgttctagctgaatggttgtgtcccaaagactagcggacggctgggaaggattgcattccttaattgggccttcgaggtggatgtcagtatagaggtttctaccattgattcggttccggtattgagggacctttcagatgtgtccttgtggccgggcatgtcgtcgggcgagactgtggatttcggtaattatttggtaccgggcaccatatcgtacggccccggcatgagttatagtagtgaaagtggaattttgtagcttacaatgctagaatagatatctctatgcactcagtttgcttacgaccgatgttggtattttgttattatgagcaaatttggctcgatgtgcacctccctatgtcaaatatttgtgtggatcgggtggcacgccgccacgagtatgttatcgggatcaggttgtgtgccgcaacagtgtgatgttgaaaataactttccatatgttactttgtatgccttgtttcctggtttctggggagagtccgtattgggagttagtcggtgaatagcgcattgtttgtgtcctttcagggccgaatggtgtatattacttgcttcaccgtgggtgtgatgggtttcttggtttcaggcctcaatctgtgcatggctgtctactttgagcatggtgacataaagtgtgtcatgtgtaacagtgtttggatagggtcgcgcgttgtggcgaggccacgtgaagttatgacctctcgaggaggattcaggtactctattcctatgatatgagacggggtctcagctttgttttgtaaaggtattgatgagcttgaggtataactcttccgtttgagtcatttgtcctgatttgagtgtgttcagaccgttccttaatgatgcgtgcattatgcaagttgtggcttaggcctgtatggaggtgtcgtattaccagggtggtgtgttgaattcgaggtgatcgttggagtcgttactgaatgcgaacagatgtgatttcagcttgttagggggttgatatcgaggttggcccaaaaatctgttgtggtaatagtcagcagggaagtgacttcatgaatggttgatctgaacaactgttacagttcattgcatgtttcatttatcgttggcagtatgtgaaagtgttggaataagactttagctaaataagaggttttctattggtatttgagtattgtgggcaactgctgtgaatagagactatcgtttcaagtgttggattgtgtggtatattgtatgatttcacctgaggttgcaggtgtgggtgattaccgctggttcaggttaattctgaatatagatgtgaggttctgatctggtgcatgatttcggaaagtgcaatgtggttctacggtttatggtctagatggacagtgaaatttcagctgtgttgtattatcggtgcctatgtaagttagggtgacgtgggatcaccccgggcatatgcctggtaaggtcatttagctattggattgcttgtagtacaactctgggtacgctcgaggacgagcgtttgtttaagttggggaggatgtgatgacccgacccgtcgtctcatgcgataccatcctattttccctattttatgcttccccgtgtttcattgtatgtgtttggtgagtttgaagtgtttcggattgagtttggttagaaaggaggcaaatagtctccttaaggaaggcttaagttggaaaagtcaaccggacattgacttgtgagttagagggcttggaatggattttcgatgatttgactagtttcgggggaggatttatgacttaggagagtaatcggaagtgaattcggaggctcggtgtagaagttagcctattttggcgaagttaggattttggcgaaatccagttggcatgcgagattttgatccaagggtcggaatggaattccgagagttgaagtagctccgttaggtgattttggatatgtgtgcaaaatttcaggtcattcggacttcttttggttgggtttggaatcgaatgcgaatttggagagttttagtttaacttaggagtggatttgaggaatttggtgatttttgatgttaatgatagtgtttttatggctcgagcaagtttgaataaggtaataggtcatgtttgtgcttttggttgaggtcccgggggcctcggggtgattttggatggttaaacggaaggtttccggactttgtggactgctggttttcagctgttgctgttgcagagcttttgctctatgcaatcgcaggggtgcaatgcgatcgcatagagggtttgaggggggtcgcctggtagtgctatgcgaatgcaggggcatggtgcgttcgcatagaaggtttggaggggatgttgaatttgttcaatgcgatcgcgtagaacgagttgcgatcgcacagtgttaggtgttgatgcattgcgatcgcaaggcatatgttgcgatcgcatacggtattttgagggctggaaattttatgctatgtgatcgcagaggttatgacgcgatcgcatagaaggtttcactgtagcggacagaagggtttaaaacatttcctccgcgagtttaagtcatttttccaccattattgaggattttgagagcttttgggagcaaatgaagagggtttcgaagggactcaaagggaggtaagttccttggcctaattattcaagtttatggaagaattaacatggaaattggttgaattcattaaaaagggctaaagttagggcttgagttttgatatttcaaattggaattttataggtcatttgaactcggatttgggagttcttggtaggtatagactcgtggcgagatgaggaatccgataatgtgagttttgtaatttttttgagaagcgggcccgaggctcgggttttgctagtttcgagatttttgctatttctcgattgttttcgattgggtgttgtcccattggcatattgtgatgtattcgctctgtttttgtttagattcgacgcgcgaggaggccgaatttagaggcaaaggtgtcgcgagcttgagacttcgccggttcgaggtgagtagtttgcatagatgatgacatgagggtttgaaaccccggtatatcacactgtgacgctatattgaggcgagatacgcactccatggcaagtgcgaggtcatttatgtttgggaattgtgactcggtccaccccgagggagaattatactatattggcgactgattcgcaccctgtattgatgatatctgggcttgatgccatgtttggggccttgtgccggcttgtagaaaccttcagggattgatattacagaattagcatgatttgcatattatttgacctccgtcgtgagtttaaaacactgttttgacatgcttagtcacgtttctaaagttttaataacttgatcatgatttcctaatgattggaactgggctttataaaatgaaactgttgtgtgactttcatgcatagtctggactgagtatggatcgggctgcacgccgcagcgattttattatgatatggcgcttgggctgtaggagcccctccggagtctgaacccccacagtaagcgcgggtacccaaatggatcgggttgcacgccgcagtgttcaagtgcattgcattgcattcatgcatttgcattcttttgatatatcggaggttgttctgttgctattatatcgttaattgtgtagaactgtttgtttagctttactttgtggcatttcgtggatttctcaccttcgagtattatatatgcattttactcactgagttggtagtactcaccccctactccctgcaccttgtgtgcagattcaggtgttccggaggcttagctgagctaccgccgtctccccgagtgtttcagagtttgttgaggtagctgcctggcgtccgcaggacctgactactcattctgtctcagcttttctttatttatacattcagacttatgtatttacttcagatgttgttattcagtctattttagaggctctatactcgtgaccccaggtgtttgggaatgtttatcagttgtttcgttttctttcgtattgctatttctacaaatattggagtattattctaaaactgctaccttttcccctaaattgtcaaatgtttggttgtattactgtgttgtgagaaattgttggtcaggcttgcctagccttacggttaggcgccatcacgaccgggtttggatcgtgacagaggtgtagttagtttttttcttttgggagaaggagccattgtgttgtgttttgaagtgcagcaatatctcttaactttgttattccttgagaatagtgagtactttggttgtgacgcttaagctcagtttttgactcttgtataagtaccttaaattgtatgttcttaaaattgctcaactgctttgactagagtgtcttgatgatccaatcttgagtgagtcatttgccatgcgtatgtgaggtttgttgtattctgtgcattgcatttgatgtctagaacttgcctcgtgtgtttgcaaagcgaaatagtagttttattcagtctaggaagtgatataggcatttctttgttgagccagatatgtatattttacccgcctaattgttatgtatcgtagttaaccctttgagcatgtaatcttgtttctttggcaaccacattacaagccttacccatttgtttgaattaaccatctatttgaaccattgtaacctctcatgagcacttgaattgtttatgaactttgtaaaagttaaagtgtggggtggttggtttggtttttgagtggaactaatgaaataaggagaaagggtacactgatttgaaaagcaagagccacttgaattgaaaaagaaaaaaaagttgtattgctgtgaaaaaaaaactttgatagtggtgactcttgatataattgtgcttaaataatttgggagttgatgtatattaatgtgaaggtggagttggtttgacataagtatgaggtttgaatgtaaagtatatgtattaaagtgcttagggaggtgtagtcactcttatatctaaatgtatcctacctgtcccgcaacctacattacaaccaaataaagtcctaattgattcaagaatgaatgagctcgattagtggagtagtacactacgggcaagcttatggtgcatcttttgtggcatatgaatgttatttctgagagtgagtgaattctttctatcttgagttcctaaatgttcgtaaattttattgcgtggaactactctcttttgttgtgtgagggcacttgattcgtgaagaaaaggtagtgtcagtgacctctatgttagagtaagtaggtgagttgtgaataatgcttggtacttgtgagtcgaatcttgaggtgaagatgttacgcttttgtgcttagtctattttaaatattcttggtgtgatgaattaggaaaattgctttaaaaaggtcgtgtctatataacatgtagtttgattactcgaggaagagcaatggtttaagtgtggggtgttgatgatattctataattacgtattttagtcgattattacactctaatttactgcactttagttgagtttgcgctttaatcgctagtgttttgcactaattgtgtgttttatgacttgtaggtgtgattccgagctatatagatgttatggaatgaatttaagtgatttgaagcttttaagtctgagtaaaagctcaaggaattaagccgagatcgtgttcgggggtcaaatttgatagttgagaacaaacgaatgctcgatgaggcatattgcgcactgtttagtaaaatgcacataacgttttactcaaaactccattttggctccataatatatggttggaaagctaacgcaatgcgctacaatttttatgttttgcgtttttccaaattccaaacggaacagggtgaaaaactgcggtttcaccgcgaccgcggcagagtgcagacgcggacaattgaagaatcagaggccatgtttggccgcggtttggccacggtagaaccgcggcaggaggcggaaatttcagagactaaagtgcaaaacacgggatttttagcccaaaaccctattttaaacattagacttcgcccaaaggaggcatgtattgaattttagagtatcttggcaaggaaaaccattgtgagagatcacccaaaacatctttcttcttttctttgattttttattgctagtttatgatgaatcttatcttagttagtttacccatagccatgagtagctatatcccttgtatgaggttttgatggaacctattgggggatgaacttcttgtttatgtgaatacaaattgctagttttaatctttatttattcaactatgtttttgttgtagttaattgacaggatcctcaattagctgtgcctatttagtgtgcataactcggaagagagtgcatatttaggttgttgttgaataacaccactcctaaagtataagaggaatctataactgcgggtttaaaggcgggattagggataacgaagccttgggtgcaatctaagtgaactgtattaattaaagctagctagtgtatctttggagagtgcaatagtatattactgtgattactcgggagagatttacggtaaggcgagcgttcatgattgctagaggtgtgttggtaaatttgtatgaagcataaacagaagggattccatcaataggggaaatcattaccttagcttttctctcatcattgtttacaaccttagttagttaatttatagcttgttattttactgcaatcttagttcgtaaagaaacctccaactgtgattcaaaagtttggcaagctggttctgaagagtttagtgagtctaaagatagtggttgataggttaactctctgtggattcgaccctgggcgtaatactcgggttatatttgcaacgtccgcattgtccttttcataaggcatagttgggcgtgatcaagctctcatcagattatgtatgtagcagaggtgcgagtattataatagagcttcgagttttggatgtgaattacacctaggtggaagggaggtcaggaatgggatagaagatacgatgcaaaattttaaggtaagtaaggtaaaagtgaacagcgtacgagatactcaaaggcagaatatgtgaatagtccatacttcggatagaattctagaagtgttgggattcaatatccaggaatgatagcagcatagtcagtggcatatctcatagcctatggtttctaagtaccgaaaggtctaattagagagtaaaataagagttagagacgatgcgatgtctctcttgatgttccagaaaagcctaagggaatcgatcgcaagctaaattatgatagaacgccaaggttttagaaagacaagagtaacgataagaagaaggcaagggagagggtgacaaaatggataagtcctcgggattaagcccgcgaaaacaaaggagctgatggttcctctaagttataaaaatctcaatatagcctgaatgaactcaaaaggagtctaagactaataacattcagaagagatggaatgctgccctgttaatagaatgagagttatagaaaaaaaatgacgtttgggccttcgattgagtaatgatatgacgaataaaagaaagggatctcatgaattggacaggattaaaatacccacgcaaggtaaatcacattggtatgccgtgagatatggttatgaaagcaaggtatcgccccaggtggatcaatctaatcatttcagatgttccccaataaaacgtgaatcctatcagcaatattacataaaaggttaagttatcaagggtggataatggatcaaaattgaggtgaattaataattgatggataaaagttataaagtacgagaagagattagactgtcattcttaagatgaacagtaatgtggaagcattagaggacatagatttatacgtatgtaataagaaatgaaagtaacctgagatttggtagcagacctcagtaacgagaaatcgaggtaagtattatggtataatatgacctatgtagatgcagtaaagtcatacgaatgaataaccaggtctataaaagaagatatagcagtattcgtaagttcgacaaaatatcaagcgaagaacttcaagattggctaaaagctgaaggaaaaaaagagaggagagtcgcataggcacacttacaaggtcagtatcgtagaaacagcataatggaaggtagcaacagttacgagattggaaggaattcgattacaagtcatggcgtgggaaagaggcctaaagaggggaatgccctggtctttggacttattcacataacagtttcctagatggcaaaaggcctactaaagtattcgcaagagctatgggatatgagaacgataagcacatcagtcaacattcgaggacgaatgttccgggggggggggggggggaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaataatgttacaccccatattttcgtacatgaaacatacgccataaataatttaatgagagcccggaagtgagatgttatgtcccatagtattatactacgataatgctacgcttcgcagtatcaaattaagacgatgttgcaccctaaagtattatatgttgaattggtcataaggtaattgacatcagttcaagtaaaagattatttggaaattgtaaggattatgctatttcacaagtgattagtaaaggtgtgagggggaagcaagtcaaagaaaataaattttcgtccaagtaggcatattgggataaaatacggcccgagctaaaatactcggtatttatggactagtgccctacgaggtaccacatgaccatgatagtaaggtgtatgaggcatgtgaaaagtgagtagtattttaagtaatttgagataattcttaattatgtggataattaattaatggtagagataattattgtactaagtggataagggtatttttgggactactacatggcatgagctaagccatagtggtaaattatacaagatcagtcataagatattgattaccttgtttacacgtaagattcttagtctctttattggtaaggtatcgaaaggaaaccacaaccaagtggaaggactttctgaagcatgtagtagtccttactacaaaagactaggaaaaccattgtcaactattactacaatgtttttgtccccggcaattgagcgtacagaataggtaatccagtaacttagtcaatattagtgtgattttgctgataacattaaggacacaaacatgcataaaggaagtgaaggccagagacctgagggtttgaaaagtcgatacctatgttggcaaatttagtccctggaagtagacaatctaaaaggttattttcctcctttcaggatgtttgataggagtgaacctttcgatacaagtatgatattttaaccatattaatatcggttcagtgaagatcatttgttcagaacaaaaagatccaacgtgaaatgctaattcaaagaaagcccggtacaatctttctcaagaatatcatacgaatttttcctactccgggtatgttaaggctatcccttctttcttttggcatgatccatacgatatgaacgaaacgtgcaaatgcacaaattccatatatgactctattcatagaagtattagaagtgcctatgtttttgaattttcatatgtattattattccatcgtctgttcatgggtctcagaaaatacgtaaaatgatgttatgatattaatcagagatataatggtcttacgacgtatcgagagattttgttattgtatttcatatgcatttcatgtatctatacatgtacattgacccatgactcagacggcgttatatacgcgtatataacgccgtctgaatacttacatatatatgcgtatataacgccatttgaatacatacccgtatatgcgtatataacgccgtctgagtcatgggtcaatctacatgtatagaataagtattgttaaaatgctcttttagggatcgtttggtatgaggtataaggatggaataaaaatttaataccaccttattactctgttgggttagcaaacaaggtataagttatcccggtgttaattttaacaccgggataacttatacctaataggggggtgggagggtggggtaattagcaccggtataacttataccttcttcttataaattatacaattgtcattcttaatacaacatatcaaacagtgaataaacaataatctcagcataactaatcccagcataacttataccggcataacttataccggcataagctctattccaaccaaacgaccccttaaagactcaaatctgtctccgctagcagggtcaaaaaaaacaagggagagaaatgacaatgcagagatgagagaaagcaatggcaaagcgagcaatttcgttaagaatgttcaacattcaatattaatgtatacaaagtaatatttgacctatatacataatattaactttcaagcgaaaggtgtttaaccgatgtcccttgagcctatgtagctccaccattgggagaaagtatagccaatatacaaggagtttaagtgtatttaaaaaggttttcaaatggctacaattttccaaaccagaatgaggctgccaaggatccaagaaaattgtgcatcattgaggaatagaactatgcatctgcttctgataaaaatgtggtgcagcttccgttagccaagaaggatcaacagtaatgacatttcgcatgtactgacgatccgttgaaacaagagaatggtatacgatccacttcgggttgaccctgtcaaatttgagagaactcattataaacttaagatgtaacagaacataataacacttcaacttatctagttttattttttcctattttatcctaaagtaacgaaggacaatatgcaaatgttagtacaagatccgtttcgagtagaagctgtgttcgcgcgggacatgaacatgcatttacgaaacaagttcagccatgctttcgttgatcaaagaaaaaaaatgctcagtgtcgatgcacgcaggcacatatacaaaggaaggatggcgacaagaaagaaccaattcctgaccagaccatgctataacaggatgcaacaatttggaacattcactgtttgttagctatgcactcgactcaacaagtatagcctcttcttagctcttgggggttttggttcagtggtaaggacaaagcacgtgatgtgtaggcaaggcgcatgtctcatgggttcaaacccaaccgcaaaaaaaacttggtattcaagttgggagagaggtagagggtcgaacccaaaatcccaggagtttgaagtccacatgggaagccctaaaaagttcgcataaaataaagaaaagtagcacctttttttaaagcatatagcagaagtgaagtaatatcatagttccttggactatcgaaacctgtcatatataagtacctgaacagcacagatgagggatgaatataaacttcttgagaagtcctgacagtcttgtacatcccattgtgactgaatggctgtttcaaagacgagcaacagatgttatcaaataggctcagatcagaaagtatgagatagaaaaaagacaataaaaatggaaagagtgtgccctttaagacaaatattaactatgagacatgtatcaaatctcatactcacttctaaacgggaagcattggcaaaaaaacctgctgtaattgccttccttactgcctgcaaaatgactaatttcagttacacctattactacatcgtaagctcttgaatgacggaaagaattgctcacaaacttttaagcaattttatctttaaaaaaaaaagttatgctgctatcaggaaagaggccaagttgtaatagctaagcccaagaataaatctttaattaaagcccttagcggcatgtgtcatcactctactttgatggccttatggtggtggagaagaatgcttcaggcaataatattttttctattgatgaagaacttcaggcaataatatttgttcaatgagcttgaagacataattaagaaaataaaaatattcccgtgatggccacacacttcaacatggtattaaagcaggcaaaggtcctatgttcgagtctcactgccacctattatcaagaaaaatatccatgtgcttggttccacacatgagggagtgtgttgaagacataattaagaaaatataagtgtgctctttctaaaagcttaaacttatagatgagatgatcacacacttcataaaatgacaagtgagcaatcagttctaaaacatgggcaactgcttcatggtttgttgaatgctattgacattaacaactgagtcagcaaattaagttacctgcatatccccttcgcaagatttcaatcctatacccaaccgttgtgtaatccttttcagttgttccctaacttcaattacttttttctgcatatagatgtagtggaaaaaaaatcaaggatgtcacaaggggcatctcaaaacccaaataatgcatagttcacaaaacactactattaataaactaaaaaggaaaaaggaaagagagaacatccaaatgcatcaaaatcctgccttggaagctggattaggacttaccatggcatgataatttacaaaattcttgtgacaccacttcgaagatttattagactgaatgaatcctttatacacatttaagaatgtgacatggtctccctgcaaaagtacagcaaagtgaaccgagggagtacttgtttagtcttcttccactcttccagtaaattcatgtgaattccaaaaagaatagcacatttatatatttccttaataaagatgtttttatagccacacaaatgttataacatgtttaaggccataagtttcaaaagcattatactcacacaaatgttatgctatatttaagaccacacatttcagcggtctcccgttctttcttaaattttgtgccgaggcaaactatgacaacagattgaaacagacgaagcaaaaaactagagacaaatagccagtaatcctaactccaactgaggatgagatggtcagtagggatgaatcaaaagaggagggatgcaaaatacaaagattgtgtttttacttggcataaatcccaggaaaggacaaacttcttattactgcaacaggaggaaaataaaaaactaaaggtgatagtgaagcaggataaagtgtaaaataaaaaaataaaaaaaaaatatatatatatatataacctcttctgtagaatgtataatttatttaaattctaaattttaaccaagccgatttccaaatgatctggcatctagtaaacgtacgaaatcttgtcaatgggttttcaattaaatcatattacacttccctgacaatcacacaaatgcaagtcgccaaaggtgaacttcatcatgtattttcagtataatgcaaataaattgttactaagatgaacctagtaagcaaaaagaagaaacaaaaaacctcggcagctgcaaatctcaactttgcttcatccaactccttctgtactcctctaacaggaatccaaatagactgcacaaaaaacaatatgttggtctaacaaaagataaaagtcctgttttattgctaaatcaattagggtcggaaagaagaggattcacctgtatggagagcgtagcagcaatggtaattatttcctcagtacatcctaactcacaagaagccaagatcattttagatattaatgggtcctatacaaaatacaggttttagaaactgagtggatacgaacatttctaaatccatgaattgatttagacatgaaatgaagagtcacattgcataattgtaatgcaccgagagactttcagtaatgcatcaagcatctagtttatcaactccctgttgatctcacacctatggcactcgacaacacagcatgcatcagtataagagagctatttatagtggacagcataagttttctttgagggaaactggtatctattagttaagattttgacgttaaagatatgtatatccacataagaataagcatgaaattctggaaaatggtgccaatagtaattttttggtgtatctgggaagaaagaaaccgaaggtgttttgatagcatttcaactccaatctactccttcaagactgtgttaatctgctcagttggaactatctcacccctgttaacagctgatgtttttgtggattttattagctccctgatagtagcataggcttttgtactagagctgattatccaatctcttttgtactcttcgcatcttcttgatgtcttctaatgaatataatttacttcatcaaaaaaaaaatttagataaacttagtttttagagaatcccgaatttttagtattggaatgaaatcaagctcaataagagtggaatgacaataaataatttatgcagatgacctcaactagcatgggtgtgaagcgtagaccataatagattgatttggtggttattttcaatgatcatagtgaaattaacgaatagagaaaggcaacaataagttagcataacatttactcccaagtacagggcatggtttgggcacactcatgtcgatagatgatgatgatgagacctatgaaacttgccctccatactttacctagtcccttgcttcttcttttttttttttataatggtgtgtgtttagtttactctaggtacctgctaccttccaccaacacagttataggggtaactttgcccaccaagacttaggcaaataggaaaaagtcacctagcattttttacctctgttgggatttgaacccgggtctcctatgattctcatctcatttcattgaccgctaggccacacccctaggcgctactttactttttctaaatgcataaatagtccttggtcattactcttgtatgatggatttcttttatccttttactggtgaatggggggagagaggtagtgtttggtgagaagtgtcataaaaggctaatagaattgtaaatttgatgggaagaatccaacttgcaagtaatattactagaactgaaaaaaggtttgctgaacagcaaataagaaacacatgaggaaattttatggtgcatatgagatggccaattagaaacataccagtggaaactctgcaacttgaaacccagtaggtgaagtaagtttggcatcgtcatctaatactccaagtgagtacagtatttcaagcgctcttatcatcgcttcaggtgatggagaagcaggccaatcaaaacccaagatattatcaatacctaaggccttcaactgggacagtgaaaagaaatgatgttagctaatatccaacacatcctgacaggctgaagtaataggatgagacttggatttgaagatttgactctacaaaggagataaaacgatgaaagtcgtagtaaaggcaacataacaatacccaaacatgccctacgtacagaaagagaaagttgagtagttgatagaacatttactagaaatttaaagatgcaaaggttaggagtacgattaagcaaccaccgagtttcaaactgtgcaccattgatcctcggcgatttctcggttacaagaagaagaaggaaaaagaatgaaatttttccaaggcagatgatttacccagcctccctaataaggaggtcgtatttacagaaccacgcctcaggaaaaaaagtcataaaggaaaagcacggcactagcatcttcttgttcaagaaaggcatacctggatgacacaggaaacaaggtttgatctctgtatctccggtattcccacaatagacatctcactggcaaaataatcttctgtgtagagcctgaacagcaaaatagaagagtcagcaattatatttcttaaatggaaaggtatttataaacattccaggagtagagacaaattaagaatttacttcttcctaattaaacatagtcatctaacaacagaattaatgacatgaataaggtgattttattcaccaactgagatctatgatagaaggaaaaaacagtaggatgctaattcattaaattaggataatatatgctatatggtttgaattatcaatatcaggaaaagttaaaccgaataactcattgagtttggaatttaatacatgaattgtttcgcatgcagaaaagtgagatggattttttttagtttatttacctgttgattagcacaagaatgattgttacatacataatatgtattccatctcagcaatgcaaagataaattaggcccaaaccaaactggagatatgatatactaacaatttggaacttagggagtgttaagcttcggagaaatcaattattatataatgatatgtatccttttattgtgattctaagggtaagtttcacattattatatgtggtaaggcacctacctaaaacacttcccaggtcgaactcttccagctctaccagccctttgtcgagcagatgccttcgatattggtgccactaccaaattctcaatatctgaaatctgatgtagaacagatccaaaatgaaaatgcaatatcaggcatgacatgcatacattgaattatcttttcgttcgtgtaaattgcattctttatgccgtaattaccagaaaccgaagcaacagaattgaggaaagctcaatacaaaaaaaatatagagttttcctcagaagaagccagagtccaacatatagaacatgatgcttcatagtgacagattaaattatcttccacgtttgatcatcaaaagcatgttttgagcatccatccagataggagcaaagtgaccaacaggaagaatgagggtcttagggataaaaaattcaagcttacacaaacaaacttattatacaagtttctaggaaggtacagacaggagtaatgatgtggaaacaggtattgcatgtaaaatatgacaatactgatacttggtgcacaaatccagataaagacttagaaaattgcgactaaatgaggcccaaaaccgacgtatgtgcagatattaaacaaaatagcagcaatgtcatcaaccacaacagactgatcaaaagcatgggaaaagagttaagttaaacagagagaaacaagtaccgggttgtagaaccgttgttttgagaacccactatcaacaacatagacaattccctgaacgcagaaggaaaattctcagctcaggaatcaggaatgtaatgaaaaacctaataacatgtatgcctcacagattttgaccccaaagtttcagatttatacctctaaagtcaatgacgtctcagcaatattcgttgaaaatatcacttttctttttcctctaggagtaggggaaaacacaagatcctgtaatcaagaaaaaacagaactatttggtgaaaagttcaacaaatcttaacctaaaaactgcatgatgcataaccccacctgatctgctcgaggaagccccgagtatagtggcacaacaaccagtcctgcaagaaaagtaaatcaaaaaaaattggtatgtatccctttttttattttctttgttttgagaaaaggcacttgatagaaaagtctggaggtctagtatcaggattgtaggataggggtctctagaattttcgtactcctttcccagggttgggtggggctctccatagatgattcatgtattggattgtgtcctcttatggtagttatttatcgtagttactgtttgatattattgcatgccattttatttatggctcttatgtttagacaattatttatgctatttctgctgcagttactaatgctctttcgtttttgtttttgtttttgttattatttttgtttttcctttccttccctgagccgagggtcgattggaaacagcctctctgccctttcggtcaggggtaaggcctgtctacatattaccctccccagaccccactttgtgggactatactgggtagttgttgttgttgttattgttgagaaaaggcattgtgtttatctacaaccacttctctattatttatcacttagcagtactattaacacaaagcaatagctaagggaattattcagtaccttgcttcccactactttgggcttcttcggtgagcaactgtattgcagcatcaatatcatcttgaccagtgagaaacaccaagatatctcccgtccgctcctaataagaataaatgaagagccataagtcaattgctgtatgatagtacattaagagtcaaataagagacaaatcgtaggaaagttatcctgatgaactcaaagataaattattagactaggcagaaattttgagacatcacgaatttcaatcattatctcattcaaagacattcactctaggaagccacatggaacacattgcagacaaatgaaacaggactgtgtttctgcaccaaaatatgtctgagtaggccaaccccctaaacttaaatggatctttggaaatttatttaccatgtgcttgcaaatttgcctcaaatttacatttgaccatgatgtggccaaatagatcaaagaagtcatgatctagttagtgtgtacctggtcatggatcgacaacactgtagaaataacggcccgaacgtaatcagaaacaggatcatcaacatagaatatctccacattaaatcccctaccctggaagatcacagtgtaaaaagataatatcagtaatgttgcaaatcaaccagagaaaatccccaacgaaatccgctacctagattttcacggaatacgtaatgattctatagtcctgttgtaactcaaattgatccagttaatcaactttattgatttttggctgtgcagttgtaaagagtaattgtatcacaaatccacatacctcaactgacagaatagcaggttctcttgttggtccttgctcctgctctcgtcgttttttgctaatattttgtcacatataaaagttttagtgcacactaaacctagatactaaaagaagataggtggctgtttatgaaaacacaattactgatttttggaacgaaataatatgatgctgaaggaaattatgatgtatagaaagggatcaaatgctgctagaaagttgaagcataaaataacaagtgttactcagaagagcgtgggaataataggtttcttacttcatgatattgaagtgtcaaaaggtatcaaactaagaactatgaaattaacattcctataagcagttcaactaatctaccacatgcttcttcaaaagtcatttctatctttatcatagagttcctgtcttcgttctcaatagcatgggtaagatcctaagcacacagacagaggcaggaaacatcattcactaatttaccaactaactagcactatgaagtttcatatatcttaaagtggagatatatgaaacaaagatagcaaagagaaatcagctgttgggattgtcttctcaactgaaattgcatcaacggaaagcaggcaggagattgggacttttgacttttgagtatagaattataaagcttcagtaaacactcatcacaagaataacaaacctggtattaaagaaagcagccattgattttgcttcaatcgtagccgatgatattataatacgcagctcaggacgacgcctttgaatctaaattttgtggaagccacaggaaacaataacattttaagagagaagaaataaaataagtgcgcactcagacgataagataatatgataatcagtctagagtacttggtgatcaacctttttcagtagtcccaataagatgtccgtcgagagggacctttcgtgggcttcatccaccattatcacactgtatgattaaaaagacaaatcagggtatgcgattttctccttccagtagacattttcaacatctatttgaaatagaaagtggattaatttgataagcctcctgagtttttgggaaaaaatcagggtactacagaattaaaagagccttcaagaacagatgagcgaattttttctttatatttctttgtgaatttatatattttcacccaattttaccagctcagattttgaagaaatgctagcgcagagttgagtgttgtcaaaggaaataggcataataaagcgccaagtgtctactggaacttcaagcgtagcccattaaaacataagcattgcaaaaaaagacgcagaaacaataaataatatatttaaaagaagatggaagatatcactacccaaagcaacactgcaattaaaccaaaaggtcagaagcaattagagaggttaaaatcaggtattaaatataaagatgggcaagctagggtcgggggagaggcacactcaaagttgattaatgaagatccacatactgtcatggaacgtgtggggattaaatgatggggaaaaaggaggacttatattaaaactgctcttaatgaatggagaagtgatgtagtagttcttccagaaacaaagatggaaggtgatatatctcgtgttgccagacacttatgggggatagatgggtggattttgtcaaccttgaagccattggtactagtaggggaattcttatcatgtgggataaaaggatactagaagggaagttgattatttttgaaagtcagagtatctcttgtagattgactgcaatagaccaagatttctcatggttcatcacaggagtatatgcctcaaattccagaattgacaggcaagacttatggtgggagttggcagcctcaagaggactttgtaatgggccatgggtggtctgtggggatttcaacacaaccagacactcaaatgaaagaagcaacaatcaccgtctcaccggagctatgagagatttctctgacgcaatcaatgatctgcagttagtagatccaccacttttggggggttccttcacttggaacaaagggaacaatcaggggattgcttcgagaattgatagatttctttttttcattgaatggatgaacactttaggaatattagagagtctactctgccaagaatcacttctgatcattgtcctattaagctaacttgtggctattgggaacaaaggaaaccatcatactttaaatttgtaaattggtggttggaggttgatggcttcaaagatctagttaaagcttggtggttatcttttgcagtacaatgacacccagactttattttagcaacaaagctgaaactcctgaaagctaaactaaaggagtggaatgttgctaactttggggatttagcaaagaggaagacagagcttttgaaccaactaaccattgttgatgttttgcaggaacaaagaaacctcactgatgatgaactgatacaaaaagccaacattgctttggaatttgaggaaatatccaaatatgaagaatccccctggaggcaaaaatctagaattctatggttaaagcagggtgataagaacacaaaagtctttcacaagacggccaatgcacataggagattcaacaccatagacacgttggagattaatgggataaaagtcattgatccagtagaaattaaaggagaaatcatctccttttataaacaaccatactttgagatagaagcttggaggtctaattttactcagaattttgcttcaattacagatgaggagcaaagttggctggagagaccttttgaggaacaagaagttctccatagtataaagctatgtgccattgacaaagcgtcaggtcttgatggttttttgatggggtttttcattacatgctgggatttttttgaaggacgacatcctacaaacgatggccaattttcactctctcggaatttttgagaagagtttaaatgccacctacgtggcgcttatacccaagaagagtggagcctaggaattgagacttcagaccaattagtctgatagggggcatctacaagattacttccaagactctagcagaaagacttaagaaggtggtagataaaattgtgaacaagcatcagatggcttttatcaagggaagacagatcatggatgttgccctaataactaatgaatgtgttgatagtagacagaaggagaagaaaccagggattctatgcaaactagatatcgaaaaggcatttgatcatgttaattggaggtacctcatcaatattctgaaagttatgggttttgggaataaatggcttaaatggatcttcttttgcatcagtacagtgaagttttctatcttgattaatggatctcctgaaggcttcttcttttcaatgaggggtttaaggcaaagagacctttgtatctcctttcctctttattttagccatggaagggttgagtagcatgatgagagcctctactatccgtggttgcttgaaggaacttcaaacagaattaatagcatggagatttcgcatctgttgtacgcagatgatgctctggttctttgtgatgctgaacctgcccagctaatgcatttgaggctggttctcacagtctttgaacgtatctcaagtcttcatgttaactggagaaagagcatgttggtgcctattaatacagctccaaacagtccaattctagctggcattctgggttgtgaagtaggaaatttaccaagtatttgggattatctttggttccaagaacaaagttgcagatatatgggaaggagtacttgataaatgtgaaaagagacttacaagctggaaagcacaatacttatccctagcagtgttattaatagcgctcgcctcagcgctaaaagcgtgaggcgttgcgaagcgagggcctgtcgcctctttcagcttgttgcgtagcgtatacaaatggcgaccgctacaggttctaaggcgtgaggcgcagatttggcgagaagcgactgtggcaacgcttttttaaaaataacagagaaaagaaaaaaaagagaaaaggagaagaagtgaagtcagaaataaaaagaaaaaagagaaagggagaagaagtaaagtaagaaattagggtttttgtcacctgcgaagtgcgcgaacaaaaacagagccaacagaggtcttcttctttatcgttcatcttcttcaagcttcaagccttcaacaaccaaaaaaggtatgcttcttctttcttctcttcttctcttctttcttctcttcttctttcttctcttcttctttcttctttcttcgacagaaacagagcctatgagtctctgtttttttgcttctttctgattatcttcttctttcttctcttcctcttctttcttctcttcttctttcttctttcttcgacagaaaacagagccaaataggctctgttgttttgcttatttcttattctcttcttctttctttctcctcttctcttcttctttcttctcctcttctcttcttttttcttttcttctttcctctgtttttttttcactgaaacagagttacagagccttgtttttatcgtttctagcttctttcttttcttctgttctttttcttttcgactgaaacaattgaggctttttttattctcttatttttttattttatctgttttgtgaattatcttccaacttctgttttatttgttttttattttatctgttttattttatctgttttgtgaaaaaaactgaggctctgttttttttttttgacttgaggcaaacagtgtacacttctagtcttcagtgcactgtttttttttctttttttctctatttatttttgtcttctttatatagtagaattaattacgtagtgacttgataatttttgtctataaaacagcgttgaaatgtcatccgataatcctaaacgagatatagcttggaattatgctatacaaggcccgtcaagaactgcaattaaatgtgtgttttgtcaaaaaacatataatggcgggataactcgtcacaagcaacatttgatcggtggatataaaaatgtaatacaatgtcccctttgtccgcccgaggttagggaggaaataaaagcttttgttgaaaagaaaaatttagtaagaactcaaatgagttatgaagcatcggtgaattccgtgaatctaattgatgaagatgatgagatggatgaagaaggtgaaatgggacctcccccacttaaaaggccctcccaatctagtgggtcatccacggcacgttcggtggcaaaaggccctatcaatctttattactcgacaaaacaacaagaaaggggaaaaggggaagaaggttcgggtaaagatgtgaagaagattttgagggatcgggccgttagtgcctttgcatcatggatgtacgatgcagggcttcctttcaactgtgtcaactacaaaacttttgataaattcattgaggccgtaggacaatatggcccggggatgcagcctcctagctatcatgaagttagagtaactcatcttaaaaaggaggtgaagaaggtagaccaaattattgaggagcataaagtggaatggaccaagtttggttgttccattatgatggataagtggacagcacggaatgggaaaatgatcataaatgtgttggtgaactctccaagagggagtgtttttcttgaatctcacgatgctagcaactcttctacggatggaagcaaaatgtacggcttgtttagaaatactattgataaaattggaaaggaaaatgttgtacaagttgttacagataatgctagtgagaatgttagtgcggggaagatgatggaagctatctatccaaacatttattggactccatgtgctgcccattgtatcaacttgatgtttggtgacatattcaaggaaaacccatatgcttcaggtaactttaatataattatctttcaagcctttaactttatttatacttatatgatatatcgtatcctatttatacttaaattattattgttacttttacagttttcgctaaggccgtcaagatatatgcttacatcagtcagaggccgttgttgaatttgatgaggaaattcacaaaggaaagaaatttggtgagaccggccaagactagatttgcaacggcttttttaactttgcatagtttttacttgcaaaaggcaaatttgagaaagctagttctttcgactgattggaaagataataaatatgcaaaggaagctgcggggagagaggttgccaaaattcttattgctccatcattctggaatgatgtcgttcgggctcttaaagttggtggtcctttgattcgggtgctccgtatggtggatggggagaaaaaaccaccaatgggctatctttatgaagctatggatagagccaaagagagtattgcagcatcatttgatggagatgttaggaaatatgagaaagtttttgagataattgatagcaggtgggacaagcaactccatcgacctttgcatgcagcaggtcatcttctgaacccgggattattttacaagaacactagtaatgaaactttggcttcagaggtgtggattggataccatgcatgtcttgagaagttgatccctaattcagcgacgatagatctaataggggaggagtttggtaagtacgaacaagcagatggcctatttggtttaccggctgccattagagccagagacattaggtcgccaggtaactaactttaatagagattccctagggggaaggatcattttagtgagctctatcctggactccctacacacctacatcatgtccttatttcctatcccagccaaagtaaggagaagaattgaccaactgagaaggaactttatttgggaaggcaacagggagtccaaaggctcccatcttgttaactggaacagtctcatctctagcaagagagttggcggtctaggcattagaaacttaagtttgcataacaagagtctcttaatgaaatggttatggagattcaacactgagaagcaagccttatggagataagttgtcaactgcaggtatgagcagtcaggacagtggagcaccaaaccagtgataactccttatggagttggcaacaggaaagccatcaggaatctatgggaggagtttacaacaaacacacgttttaggaaaggaaatgggaggatggtatcatgttggcatgatgattggattggtcatgaatcattgaaagatctatttcctaatctgttcaatctcaccacttcacctaatgccacggtagaagaaacttggagctcccagggctggaacctaattttcataaagcttctcaatgaataggatacatggaaaggaggcaagggctctaaaattacagtcaaggcagcatacaactatctatcatccagaggacaccccaactatcctcggccttggaaaaagatttggaagatcaaagcaccattcaaagttatcagctttcatggttagtggtaagaaaagcctgcctcgctttagaaattcttcaaagaagaggtattcagaccagctctacatgctttctatgtcaacaggaagatgaaaccaatgagcatcttttcttacattgtgttattactagacaactttggcagctctttatagcattagctggtattgtttgggtaatgcctaaagacaccattggcctgatatgcagctggaacagcattaggggaagaacctgtcacaaggaatggtggaaaattattccagcttgcatatggtggacaatttggaaggagaggaatgcaatgttttgaaggcaagagcagttcaacacagaaaatcaagagttcttatatttctcttttttatttttggtgtaaagaacagttgatagatgatgtagaatcactactagacttttttgattctttgtaagattttcacgggctgtacttgtaaatattagataccagcccctttttgggtgctgaagaatataattgttacctttttcaaaaaaaaaattatatatatatatagacacacacgaaaaaaaacatgtaatgcaaaaaagataatcaaaaaacaaccaagaatcatttggactaagaatttgaaatttttgcaatcgggtgagacatgttgtcatagatttttcccccggggctttagtctagtaataagagcgtaatacgttatgtgtgcttaaacaaacgtcacggtttcgagccctgccacaaataaaatcctagtatttaagtggagaagggtaaagggtggactcattacgcaccaagtttcgaaccgtgcgcaactagcctcggggattctcagctttgaagatatcatttggaatttataattttgaagtaagaatgcaattttaagttgatacagaatagtgaccaattttcttatattaaatttctaatcactaaccttgttatccactatgcttcttcaacaattaatagatcactttgtcaactatgttactggttaagtatttcccctttcaacatagcacttgtgagccctcacgcacaaattttagcgccttcgtttctgaaataatgtgttaaaataagcgaggcaaacactcaaccaccgttgcacccaacttcaggtcttaaccatgcttcaggtagacctctaataacattattcttatttgtggtatcaattcatcttgcacttgcaaattataggtctaaagcccgacataactataaaataacccacaattcacataggtgtagggggaatcaccaacgaaataaaatatataatgaagcaattgcaaagctaaagcttagcactatagataaagagagcaaaatttcattactcttaatcgagtattatccaccggagtgaaaagacggatgacctttaaatattggtcgatcttatcctgagctttacggaacttgttgacaatattccatcccatagccaacagataaagatagctcatatcctgacaactttaaaccaacatgtacctcaatgcgttttcaaattgtcctaatagctctcgagtttcgggatacttcttaaggactgcaaattgtagctggtccaataaattatcgattaacttgagatgctacgcgagttgcctccaattctttttgtgcatccgagctgtgtttgcagcttttacaatcaacccaattagtttgactgaatcaaggccagaaagctcccctatgttctcttacgaacccatccccaatcatgtattgttcctctctatggctataaccatttactttcaagtcaattacaaccccatatcaaagtaatgacaaaaacacgatcagaggctcgctcgaaactttaatataataaactaaccaacaagtttttctaggttgatctttttctactcttggacaagtaaacctctaaattatcccgaacttgcacaagtcaacgtgcagacggctgattcagacactatattaaaaagtggacgagtatatagagtgtctcagtcaaatttaaatacaagtgaacaatgacttgcaaaacactcgcacccgaattcgatgaactgactctctctctcttcccctctctctcctaatttttttattaaactgaaatggagggagtataaatttacatctatatttacaaagaattagtagttgcagtatattttgaacttacaattttgccccgtgtgtatatgcacgatatatgtagatgtgtgtttggattaatgtgtatctgcgtatgatgaattggaccacattacaggtttatcctaagaactccggagaattcatgtggagtagtaaggtgaaggcagcatcaccattaactcaagtaatgttgttgaaaatgttactcccgttgtcccaatttatgtattataatatcttttttaatatgtctaaaaaataatgtcatatttcttcttaaactacatgctcagtggccacataaattgggactgatgagtaattgaattttatgttgaaacttgaaaattgtctctttgtcaaaacgaaagtgagaggtccaatgaggtgttgactatctttgagatctcgttgattgatttacatgctcttgagcaaacattcaggctgagtagctatttctcgcccactttttaatacggtgcttgaatcagctaattgcacgttgacttgtgcaagcacgagataattaagagatcaactcgtcaaagataaggaaaagatcaacttagaaaaacttgatggttagtttattataggccaaacccataaacggcccctttaagttggctgacttggctctgcgtttcatcttggcacctctacttagaccttttccattttgacattccaaccccttatctcatgtgccatttaaacacaatgagataaggggttggagtatcaaaatggaaaaggtctaagtggaggtgccaaaatgaaaagcggagccaacttaaagggggcgcttatgggtttatattaaagttttgaacgaacagatgatcatattgtagtcattaaattgatacgaggatgtagttgtaattgacttgaaagtaaaagcggtatagcagtagagagaacaacacagtattaaggatggattcgttggagaacataggggaactttctgaccttgatctagtgaaactaattgggatgattgtaaaagctgcaaatacagctcggatgcacaaaaagaattgcaagtaacgggtgcagcatctcaaattaatcgataatctattagagcagctacaaattgcagaacttaagaagtatcctgaaactcgagagccattgaacaacttcaaaacgcattgaggaggtcttacatgttagtcaatagttgctaggatggagctatcttaattttttggctataggatagaacactggaaaccagttccgcaaatctcaagacgagatcggccaatatttgaagatcatccctcttttcacttcggtggataatgctcgattcagagcaataaaactttgctctctttatctatagcgctagacttatatctttacaatttcttcattacctattttatttcgttggtgatttcccccgcacctatgtgtctgttcttacttatataatctaactagatgattaatcttaatagcatccaattgccgttatggaacctcaacttggctacaacgtttgtagctccttatcgttggaagaataatgaatagtttaaacagcaaaacatttataacattatacgtcaagtctcaacttttacaatcttatactgaccaagtccaagagcccaacaacacatgcatgatatatatatatatatatatatatatatatatatatatataagtcaactaataaaggcgagtgtccaaagatgacagaatgtagtaagttggcccgctaaaaagagaaaagtgggtgcacaattctgaacctctcaacaagccaaaagcaaatgaaagctcccaacttctgcacattgtctttacatcacacatagagtaaccaaccaatttcttctcagcgtaccaaacagacatttacttttccttcaatcagaagccaaagtgtcacaagtctgcttacataatactctattttgtgatgtcctcctagcctgatcgaggcggcagtttagttagaaaatgcaacagatgagaaagtaggaccaatgtttctgtgaattgaggtagacctcgcgtacccatccaactcccaacaagctctctatcagttgaatccgttcaccgtaacatctttaaaactaacacatctctcaggatgagcatccaataaatgaagcagtcaaggctttaggtgaaaccgaacataggaaatatgtccatgatgcaacaacagaaatatgttcagcaaattcgtaagttggttaaggagagacaaaatgctctcaggcacaggttcctaggtaagtagtatcttccaatctacgaatctaaccttcatctttccgacgactttcaccaccggagaaactgagttttttcccaaatcatcttccatgattgagtaaaaactagtttaaacacatgtttcttcactgtgttgttacctctcaactggggcacgtgtttttacatgtttttgactattgtcagattgaattgcatcatgccaaaagatacaatagggtgtttggattggcttattttaagtgcttattgacttttaagcactttttcagtttttgttgtgtttggcaatgaaaaaaagtgcttaaaagcacttatttttcaggcatgaaaagtacaaaaataagccaaaagttgggtattaccagcttatgacttttgtcttttaacttataagctacttttgaaaagccaattcaaacaccctctagacctcttgagatgttgggctggtgtgacagatggagtcagactgaagaaatggtggcggaagaccccagcctgcatttggtggacagtctggaacgagagaaactctggatgttttgtggatgctagcaatcccattcacaaaatcaaaatgaactgttaatactttctcttttttttggtgtaaagaatgtcatgtaaatgatagtaagtccgtacttgatatcacagaatccttgtaagtttttgtagtagggggaaccttttactgtttttgggatatgtattttgtcacttctatcaacacatactttgagttgtttacttttataaatgttaccactctcaaagtaaaagattctcgaaaagcaaaatggttcttcacttttagaaagaggtgggtgtggcacctattgacaacaagatgcggaaagcgcggcttaggtggtttggtcatgtgaggaggaggagcacacactctggtgaggaggtgtgagaggttgacattggagggcctacggagaggtagatgaaggtcaaagaagaggtagggagaggtgattaggcaacacatggcgcagcttcagctgtccgaggacatgccctcgataggaaggtatggaggtcgaggattagggtagtagagcaggtagtctagagtgttcataacagtagtatttgtacgcagtctcgcttcctgttggtagtaggtttttatgactaacagttgttttctttcattgttgatcaccatactgtcttgttatttttattctgcttttatatggctttttggtattgtcccttcttgtctatattttcattaatgtggtgcttatactttcctgagccgagggtctattggaaacagcctctctatcctcacaaggtaggggtaaggtctgcgtacacgctaccctacccagacccccacggtgtgggataatactgggtatgttgttgttgttgtagtagtacttttagatagagggatgatttgaagtttgtgtgacgagatgatcttaactctacccttaagtttctctgagaacagaaacatgtggttcaaataaacactcagaatgctctaaagcctcatcattctacctaaaacaaataatttaacttcagacgtcaaaactagaatatctgtgctgtctcaactgtgttagagattctttaaacctacatactaggcagattacccctgcagcacatcataaattgcaaaagcctggatatggccgtcgagaaataagttacatgattatggagctagataccaaattggaagagcaaagcaactaatgaataaaatgtagtcctctgtcacttttgttgactaactttgtgttttagcccattccagagctttgacctctttcctagaatggcaacattttccctccaacaattcaaactgataactttttcatccgtagcggtggtgaccgagctagccggcacgcacctcgacttttccattgagtacttgctaccttccaccagtacaagtacagagtaattctacctaccaagacttaggctggtggaaaacatcaagaaatcacttagcatttttgtttctgctaggatttgaacctcggtctccctcctatgattttagtccacattgttgaccgttagaccatacctttgggtgcaacaattcaaactaatataaattaatattgttttatattaattccaatttgatcccctctaacaattcaaaatagtataaaatatactactttatattaattccaatttaatgtgacatatttccataatacttctccactttttgaaataatagattattattgcaagtcttccaccaaacacaatattctactaaacattgagccaatgttacacttggactccgtgaaacttaaaagtcaaatatggatagacaacaacatacccggtgaaatctcacaagtgagacctggagagaatagtgtgtacgcaaaccttacctctatctcgtaggagtagagaggttatttccgaagaccctcggcccaatgaaaaatggaaagaagcatagtaacaacatcaatataataagatgacgaaagcgaaagaaataacaagtagtaatataactccacgaacaagaatacaagactagatactagtgcaacgggtatggcaaagaaatacactcaactagccacgaatcctctatactagtcctcattctccacaccctccgatcaagaaaatattggatagaacgagtaaataacagtaataaagcacctagatgatgaagaaaatagaaaaggaggcacaaggcaaaaaaaacataaacagtacctatacttgctcaatagaggatcatccatcatttccctcagcaaaactccatcagtaagaaatttgaccctagttaattcctgttgtacaagaacacccccattactattccatgcctttatcccccaaaaaaaatttattcaaggtcaacatagtcacaaagcaataccaaaataaacttaattcatttacttgaaaaaacattataagaccgaacaccttgaaatatgcaatcccaacagatgtcaaaagatatatctgttcttttggaacttatgaactctaaaaatacccatgataaagcaaaatattattcctttatcccagtaaaatggtaagtataaaaaaagagctcccacctcatttgtgatatcttcaaatcgaatagtataacccacttcttcaccaagtttaacatccatttcttcggcaactcttgaagcaactgcctgcaaaaagattgagacttgaaagaaatttttcgtattactcgaaccatagacattatggtccaaaagattatgagcaggatgtctgtgttgatcttcaataccatatgcttgggccaacatgtggtgctatatttaccagaagttcacaccattaagctgaactggtgacgcttaagagttaagacagaatccaacagaaacaagcatagtcatcttcacagtttcacaaaacaagttttatgttacgggaagcagttagtatccggttgacttagtaaaatcaattccacactcttttaagcgcaagaacactaactaaaattagggcaccatgtcaatattaaacacttttcactttcttaaccaagaaactaaagttattacactacagacaatgttaactgtaaatacaagtatccggatgactctcaaaaagaaaattacaagttcaaatatatctgtccctcacaaaatgatatcagacatacatataagaagacataaaagttcactctttaaagagcatatagtgcttagtcacagaatatcatacctggactgccagcctccttggctgggtgcatgctatcatacgccctccctcagcccagccagcttctttgaggtactgcacacattaaaatgtatcatataccattaagcttttcaagtttcaagaaaaaggttcatttttccagacgaactaaaacgaaatgtttattcacatgtcctagacaaagaataaagatactacaaccatggtgccacttgaaagtgatatgaaagaaaaactgttgtttggtaaaattatttatgatttttggttgccaaacctactgaagaattttacaccaaataagaggaaaacaatttgctgcctggctttgtcattttccgcttcgctcccactatatatctcttgctcctaccaacatatatactttacttgcacactttcttaaaattattagtaagtaccacctcacatgcggcataattccccctccccccagccactatcatgtcccaccaaatttattttctttttttcgaatttactttcaaccgactatcggaaatgacataggaaatgatcttcttagataaaaatttctaatatatactattttttatggataaattcgcctatgtgaaaagggctccactcctggatcaatggaggagccacatacaaggaagttcgtcggattattaaaaaggacagcccggagcacaaagcatcccgcattcacgcatggtccggggaaggacctcatcccaaggggtgttaggtagacagcctaccctaatgcaagcattaatagctgctttcccggcctgtgacctataggtcacacggagacaactttaccgttgctccaaggctaccatgtagatatggtaaaaacaatttttttgtatgtttataagtttttgaattgccttgatataagtgtagcttttagtgtagtgactaagaaggcattttttgaatccccttattggaattcatggctctaccacagtcccgaataatggaagagggttgatggtcaaatgcaaaatagtcttaactatgatgaattatctgaatgctgcataacagatactgaggtctaagattttatacagccgactccaacaagagtcagggctgagacacagttgattaattgaatatttttctaaagagaaccttttacctcataccaaattaaaaaatatcaaatgtacagaaaacaaagaaaaacaacctgaggaatttgagtggttttgccactgccagtttctccaacaataatggtagtggcatgagtctccactaagtaaaggatatcagttctgtacttgtacacaggtagcctctgcctttgcttgtctaaactcccatatccaaatcttgaaattccacaaatattatataaataacacaacacagaaattgaagtgttgggataacatacatatgcataacaaagaaagtagtaaaagttacccagaggaagaagaggaagaagaagtggggtagagcagaacaccaccctcttcatcatctacaagacggggacgttcagttcctggtttccaaaattgggacatttttgtaagctggagagactttttgaggttcttttcttcactggaaatttcagactggagaggaacaagaaagaagacgagacatgaaatgggcaaccatcatttcttccaactgaaattcaaaactacaaaataagaaccaaaaatgcaaactcaaaacaactgttaacaccaaaaaatcataatcaacagaagggagttgggaatttgaaaagaatttaaaaaatggaaactttcaactgaaattgagcaaaatctatattttaaaagaatggaaacgttcgtgctcataacgacgtagtatcagtggattgtttatagaattacctaaaatcagaagattttgaggggaatggaaactagggcgttgaagctgtggaggaattggaggttgaatgtaggttatcaaaaatggcggagtttgtactctgatcttggaggggggaactgttagcagaaacgaagggggaacttgtgtttgtattagggattgcgtctgtagttcaatacaagtcgcaatcctgaaacgcgtttaaaaatcgcaatcaaatatcacaatcaaaagtcgcagtcaaagattgcattatctctatatacaaattttttcctttttttccaaatgattttttgaaaacaatgtttggtcatcggacatacatgaaccgggttgctttggattttatcaaaatcaaatcaaaccaactatattcatttgaattggttgatttttcgggttttttgttacttaaatattatttcaatcttattattttgttaaaaaatttataagtaaaaatataaaaaattgacaaatatattatctattaaaatattcttatgagagaattttcttattaacacataatagttatttttttagtcatctgacaataatatttcgttgatgcacgctttcgatgttaaccgaatttagtaattaaacataaaaattaatatgttacctaaataataatgatcacttcacatcagaaaagatataacaatttaatatatcttaatatatgatatgaatacgaaagaacaaagagattgacgtatttcggtaatacttgatgagaaaatgatcatacaatctattatttaaggttaataaatatggaacactttatatactattaaatattatatcctgcaagagaatcccaaatatttctagacattttttaaagaaaattttatataaaatcttaaaagaaaattttcttagactcggtttggttcgggttttataactcaataccagaccaaatcaaacaaatctagtcgaattttttaatcggtttagttcgacttttcggtttggtgcgtttttccggttcggtttgtacacccctagtcatccccattcttaccaatttttcctttttcaattgaaaatgagaatttgctagtttttaggtttacaaatttaccgtatatttttaaaatttataaaatgaccctatcaatttttcatcttttgcagatacattttggcggctgatggtagaacatcagtcctagttgatacttgaactctgtctactcgaagtttgattatatgattatgagaaatatgtggctatgcctgcttttgcaccttctctgtgtgttagtagaattagaaaatgtgatattaattttgcatcttatgtgtattgcagtaaagcagaatatgatagtagttaatcaacagcattttaattgtttattttaagtaggataatcaaattgtgatgttttcatatttttttacaagttttaggatataaatcatgtttcatgattttgaaaaaaaagacattcaaatatgttgtaaaaattataaccaaacataatttcatcttcaattcaaattttagtgatattccaaatttgaaaaaaaaaatagaattcatgttcaaacgcctactgtttgcttgcatatttttctattattatgtttgacactcttaactttactttaaaaagcaaactttcctctcaactttaagcaataaacgctctccccctaatatgtcaagtaccatacattatcaacctttatctttcttttacttcttttttaaaatcatatatatatatattgaaaaaataaatagtatttttagtgaaataaatgaataaaatattaaaaaaattattataacaacaacaacaagcccattaatttctcattagtggggtctacaaaggataagatgtatgcggtcttacccctaccttggaagggcgaaaactgtttccgattttattaataataattaaatattatttacacaactgaaagtggaaactttataaacatatcttaatgcatatagtacgaaaaataactaataagacagaagtgaattttataacaaattcctaaaaattatggtggcatgagtttccacttggtgaagaatatcagttctgtacttgtacacaggtagcctctacctttgcttatagctttataccaaaatcttaaaatttcagaaataattatataaataaaagggtaatttcacggataatcaatcttaattaatccactaaaagagaaaagacgataaattaagtagagaaaacagtgggatacaacaatttatatgtaaatcttaattttgattgataaactacgaaaatgaatcttagaaaaatcaactaatatgtttgaaaaatatcataaacagatatatgaagtgaactggcattttttgctagtcacagttttttttgttcgtcattcactaccaaaagaaggccatattttaaaggaatttttataaaccattatagtttagagcctactaactatagtttgtctaattacaattcgtaactaccatttaattgttactaacttgtattcaaacgcgcaacgaatacaatatgccaactgtaaccaaggcaaaatacaagaatgtatacaaaggatacaacttgtatcgaatacaatttgtatcgagtatatacatgggtttatacacaaataaggcgaaacacatgaatacagaaaaataaaatgtacttgttgagagttgaactgaagacctccactaataagcatacgctctaaccaactgaattataagagcttgttgctctcttgtttcagtttaaaatgaatctcttatttcatggatttgctataaaattcaaatataactacaaatgacaaatttgctaaaaatatagctacgaataattaatatagtgtaaatcgatcaaagcttccaatagccaagccctaggcccatgcgatctatcgcggctatgggttcttctgaacccagacttacaccatctatgcgtgtttaagaaatcactaaataagtacaagtaaaaggtttcgaatccagcaaattagacgcaatgcgatagaaattctgagtctgaaccaataaaattcaaatactggatccgcctctgaatgatacattagaagctagtgttgctaaaaggatataaaaacaactcactcagactctcagagaaagaatcaagtcatcaccttcagttggctcaactattcccacagaaaactcagcatctaaagacaatccctcacaagctagagtaaaaagagcaacctggtgcactaagctcctgctatgcgtggggttcggggaaggaccggaccacaagagtctattgtacgcagccttaccctgcaattctgcaagaggttgtttccacagctcgaacctgtaacctcctggtcacatggcaacaacttcaccagttacgccaaagctccccttcaactcacaagctagagtagctggaataatttgaggacaatcaacaaaagcatttctggtgatttttcacccgtagtctacaattgccttttataagttggaaccaacagaaaacaaactattgccttttcaatgatcttcacaccgttaaacgctctttcatgatttcgttccaaattactcaagtcgtgaccagagaagttcaaataggttctctccaaggggaaacgccacaaatgagctaaggttggttgaacgatgtggcacctcgactgtacacctgaatacaagagagaaataaaaccgttagatctattttctgcagtaatatctatgcaattctaatgacgacaaagataacttggaatccctttataacaagttcaatccaggcgagaaagagaaaggagaaacttgcacggaaacatcagtttcgagtgttggcatatacaaatgaatgacaagaatgttcatgctaacgaagataaaaaccactttaaacaaatgaaaagattgtctaggcacacaaactaattttccggatattctgaatttcctgatttagagaaaatcaagtaaagaaaatagatctacagaaatagaaccttttcaattttaagactgtaatcttccaatacagagaacattttagcaagagccacacattgattcagatgcctttaatggatatctccaactgctcgatccttttggctagatcatgcttcccacaattcttcaatccatctgtgaccatgtcaaagcttcgtgacataggaaacagatttaactcagtcatttcaactaaatagttagcagcctctacaaatctacctccacgagtgcacatctttatcaacatagtataaagtggtcgatttggtggatgccccttcagcttcatatcactgaaaaagctaaatgcatcgtcaaactgtcctctgcggaagaaggcttttagaattggagcatataaactaggaaacggccgctgtccatcttcaattgaccgatgaagaatctgaaatgcctcatctatcctccctacttttgatgctgcagttataacaattttatatgtctcaatatcaggacaaagccccaatctacaaacatcattgaaaagatcaatgcaaaagtctatctccccggttttacatatagcttctgccaacgaattgaaagttccaacatctggaacgaacccctcctttgtcattttcctcaccagtcctttagctgattcaagatagccagcattaagcaacccatcaattagaaggtccctcccgcgtaccggaggattgaatccctttcgactcatttcctccaaaaactcttgtgcctctctcatcttccctgccgaacaccagccatttacaagaatggaatatgtcttcttatccggaacagtaccttttcgtatcatcctccgaatcaatgcataggccccttggaaattcttgacctcgcaaagagcaaaaagcagagcattgtatacttcggtggtatgaggacaattgaagttcttgagccgattgaagagctcgacagcctgatcaatgagaccacgcttaccatagtgttcaataataaatgaaacgatggagggtgagatagggatattctgggctttcatctgctgaactactttccacattgtctcccagtgcgcagtccgggcaagggttttaagaagctcttcgaactcgacggtagttgggtcatactgagggtgttgagtccgagcccaattaaagaagcgaaatgattcaataccatgttggtgacaacttcgaaggatacggtacaccaactctgagttaacaatactagaaatatgcatcttgttgagtgtccgctccatgtaaatatctcgccgaacaatgttagatatatgatgaattgttgcaaagtagtcatcattaggtacacttctgctgcaactacctttgccgacgaatggattgctatccaggtcaacggaaggtgttaaagttgtaagacacctaaaagtgctggtgctgttggttaatatagctgaatatgaagtcctttgaagaaaggttctggcacacattgaaagcattcctgagtagcaaattggttcaaatccgcttgtggtaaactaactcaattatttggaattccagctgcattaactagggaaaagagtatagaatgcagccatatcgagggtcgagtcctacaaagtttgaaaaatgagcatacatggaaaattcagcaaaatctccactcctacttttaatgctaaatggttatctccggagacaaaaaaaattaattaccagaggtatttctaattatctcagagatataataaccaagttttcaggcacagtgaattgccttaagggccagttaaaacgggcttggttcaaatggttagaaattgtaatcacatggttaaaaaattagaccaaatgatccgaaattgatatacaagacacaaacaagtgtacttttgctaaacaagcatcataaaacaatcatgaaacaaaattttattattaagctccatatcttcaaccccgtttcgttagctactcatacatgaatgatgcaatatttatacaacgaggtaagtgaagagtgcatacaccagctctacgctttaaaaataggcatttgcctcagttgtgtctctcattcgtcttttctgcacttaagaaggcaagtaatgaggatttagcattatcctttttccaaaaaatgaggatacatgtcgtctttttgagtctgtcataattctcacgcttaataataaaattacaaacattgtcacctcacaaattgcttaggatcttatcacaactgcacggcattttacaccataaaaattccctattccgaacttactagagaggaggcagaacttacagttactaatctgaacgaaattctttgaaaagcatatctttttacaccaaactaaccatttagttaagcaatgtaacttttccctccgatcaccaaattactttgtctaaatcaacgaataggtgacgaaaggtttttgattaagtcataccaaataaatccattagttccttaagactcaaaacacttatcaatctgatatcaattgacaaccatgactttagtccaattttatacaagtttcttttcaaaaatcatgtttggtactataagcacattagatcaattcaattcgaatatcctaaggagaaactacttcaaaccaaaatctcaaaaaatggacaaagaaaccttgaaaagataccaacaaattacaaaagaacaaataaagttgaaaactttaatcctactcaaatgaccattttagataaacttaacacaaaggaccacaaatcaccaagaaattacaaaaaagaacaaataaagttgaacacttttatccaactcaaactgaccatttcagacaaacttaacattaatcactaaaaatcaccaataaattacaaaaaaaaagaaaaaaaaagttggaaactctaatcctacttaagaggccatttcagataaactaaacattaaacaccaaaaatcacgaagaaattatccaaaagaaaaaaggctgaaaactttaatccgagtcaagtgaccatttcaaaaaaatcaaattttaaacaccaaaagtaaaaggaaattaagagtaaacagaaggattaagtgtagagacgctacctccttccctccagccgttgataaattcagcgccaattatgcttcttatgcaataagttcgaaacttttgagtaaaattcccaaatttacaaacctcgacacccttcagcaaattgaagtacataaaaaaagagaaaacttgagaattgtagaaaccttgtgtgtttttgtgcaactgagaggtgctagtgcgcgaaaatggggcatttgcacaaatagccttttatgaagtcattatttagattttgtctccgttagttcattcgtgtaagggtgctagtgcgtgaaaatggggcatttgcacaaatggccttttatgaggggaaagtgcacagttagccattctcaggacgctatttagaaattagtcagtattattttgtcctgaaattttaaaccaaaaatcataacttcaggataaattaggatatttttgtcctgaaatattaaaattcagaatacactggctaattcttaaataacagccctttaaaatggctacctgatgtcatttctaccttttatgaagtcattatttaaatttgtctctgttagttcattcgtctaaaattggctgcattcgaatatatttattcaattacttttgaaggtaaaattaactcattgaattaaggatgatagaagttaaagagtgatatcagaaaaggtcatacgatgcaattttttttatttctttgatccagacttttgttgaggtcttgagcagtgaggcgtgggaattgaaccaatgaccttacaaaagtttagaacccttttgaccactaagttatgcttttggctatgtcaaacaaattcaaaacataatatatagaggtaaaaacagattttactttacataaacagtataatttttttcgtctcctaagtccgcccctagtcttgaggagctgctagttggatcgagccagttaaaactaaagattggatgaactcgatcgttgttcgcgaaccttaatttgtgaaatcatagcagaaatacaaatatttctgctctgattatatatatatttcatatttgtggtgttactgtcaaattatatagatctcgattaattggaagtgtgtagggagagcaggtgtggagcggttgactgggttgtttaatgttatttttaagacgaaaaggatgtcggatgagtggaggtggagtacggtggttccattgtataagaacaaaggggatatccagagttgtaataattataggggtatcaaactactgagtcataccatgaaagtatgggagagggtggttgaggcaagagtgaggatgacagtgtctgtatccgacaaccagtacgggttcatgtcgggtcgttccaccacagaagttagacaccttgttaggaggttggtggaactgtacagagagagaaagaaggatttgcacatggtgtttattgacctagagaaagcatatgacaaggttcctagagaagtcctttggagatgcttggaggcgaaaggtatgccggttccttatgttatggcaattaaggacatgtatgacggggctaagactcgggttaggacaataggaggggactttgagccttttccggttgaaatgggattacaccaaggctctgcgctcagtccgttcttattcgccctggtgatggatgcgatatcaaaccatattcaaggggaggtcccatggtgcatgttattcgccgacgacataattctgattgatgagtcacgatccgatgttaatgagagattggaagtttggagacatactcttgagtccaagggcttcaagctaagcagaacgaagacggaatacctcgagtgtaagttcagcgacgggcggggggaagtggacgtggatgtgaggcttgagtcacagattatcccaaatagaggcagcttcaagtacattggttcggttatccacgggggaggggagatcgacgaggatgtcacacaccgtattggtgtaggatggacgaagtggaggttagcatctggagtcttgtgtgataagagagtgccaacaatactcaaaggtaagttctataaagcggtggttagaccggccatgatgtatggggccgagtgttggcctattaaaaactcacatatccaaaagatgaaagtagcataaatgaggatgttgaggtggatgtgtgggcacactagaaagggtaagattaagaatgatgacattcgggagaaggtgcacgtggcccctattgatgacaagatgcgggaagtgaggctcagatggttcggacatgtttagaggagaagcccagatgctctagtaaggaggtgtgagcgactggtcgtggaaggcatacgagaagaagtagagggcggcctaagaagtattggggagaggtgatcaggcaggatatggcgaggcttcagatttccgaggacatgacacttaataggaagttatggagatcgcgtattacggttgtaggctaggaggtagttgagtcttgcgttacttagtacctttgtgagcctagttcgagtggggttttgtctaagatagctagtgacaatgttgtgttttactattttctcttttcgatgcaggatccatgtactaaccatcttttttgctttgaacttttttaactttcctgctttctatgttccttttaccctatgatttccgtggtgaatctaatactctcttcttttgtctttttattatcttgagccgagggtctttcggaaacagcctctctaccccttcgggataagggtaaggtctgcgtacacactaccctccccagaccccacatatgagatttaactgggttgttgttgttgttgttactatctcccatcagtataatcaaatatcaactcttcatatgtgttgggaatcacaaccaaaaaccgttaaaaaaccttgtggaaatataatattatcattggatttgttttccactagctttcatattttgacaatcgaaacattgacctactattgatggtgtagtcaaaatatagctgaatttactataaattggagtaactagatttgaagaattaatattatattgacccataatatttatttgagcgaaatttgcaacttaggtcaaattttaatatggactttaatccaatagaatttgtgtcagctaatacaagtttcagccctttaatgtaaacaaaatgtaatttacatataataaaagcacagtatacaaagtaccagagatgatatagtattgttcaaagtacataaaataaaagattaacaaatttaaagagttggcaactaagtatagtgcaattcatcgtgtggagtttcactttttttaaatgtttggtaagccaaatctttttaaagtatctataaataggaggaatacatattatttgatcattcacaaattaaatattaacaaaatttataagataattcgtccaaatggcacttaaggcaaatgttcttattctttctttggttcttttgataatatcatcagaagttattgctagggatatggttgatccttcaatatcattgcttgaacgtaagttttcttattactttttttaactttatttttattaactactaattacaactttgagatgacaaattaaattaagtctattgtttaatagaaaaagggtttaaaaaaatcatttactatacgaaaatgctgaattttaccctccattacacttcaggatcatttcactatatccttattgttagcatagacggattcaggatttaaatttaatgagttcgacttttaaattttttagcattaaactcattggcccgttatgagattacactggatagttgttgttgttaaattcactggaccgttcaaattatgggtttaaacctacaactttgtcagattttagtaggcttttaaatataaattcttactctacgtcgaaagttatgagttcagttgaactcgtagctgaaagactacatccgcctctactcattagtaaattgtcttgtagttacccttgattctaatagagctttaacctaaaatactaacatatggtatttaaaaactattttgcaccttttcttttaaaagtatcttgtcacgtcgaactcagatagtctatactagagctcctttaaagtgaaatgcaaatatgagacaattttttttggtaggaaagataattcatattatataaacttaaagtagtacagcacacctaattagtaaatatgagacaatttactaataacaaggatataaataacctaaaaatataacgaagggtaaaattacgatattttctattgtaaatgtgcaaattttattctaactttccccttgtttaaataaccatggtattattttagaggcggatccaggattttaagtttatgggtttctgtcgcaatctcaaattaatatacaataataactgggttcacaaatagatatttaataaaaaatgtaacaaaaatacaggatctacacaaaagtttctgggttcccgggaacccatataacatactctagatccgcccctttattatttgactccaaaaaaagaacagatagaagaaaaaagctacttgtatttgctatatttaatttttgtaacatatttcatttttccactatctaatagagtactacacatgatttttggtgcagcaaataacgataaaaaaacaaatgggatgaatgacgcaacactccaaaagataggcggaaaagttggaatgtttttcgatttcatgtgtgcagcttgcaaatgccaaaagggtaataatgacaataatgataatgataacgataatgataatgataataataacaataatgatattgtctgtcaaaccgtttgttgttagtcacaaaaggcacaacaatattgaacgatcatcttctttcgatccattatttatactatatactttgtgtaataatatgagattgattgaataaaggaaaactttggatgatcgttatgttaatttccactttgtttgtaataataatacgagttgttataaaaacaatgtagtacgagttgcagtgtttatttaattattatttgtgaaatattgtacgcgagatcatggtcattttttacttgttatataatataagctatgaatttgaataaatggaaggctttgtagcctcattctgtttggaaaaaaacaagcacaaacaatgtgtacgacaaggtagtaacaaaataatacctaagtctaactttcctcaatctatctgaaccaagagaagagaaacaaactcacgcacaaacgtatccggacaataagtatatcaaccaataaataaattggcaaggcaaaaataacatttattaaatgaatgaaagctaacacaaatttagactaacttataaaaatcaaacattatattataagagagagagagagtaactgaacggaagtgggacaccatcaactaatgtagaaggtttttgctcaacggaaaccaactgaataccttcctctcattgattttggagctgattacttcctcattaagttccaaagagaggaaaatatgttacggcacttcgtgatggtccttggtttgtgctcaatcatttcctatttgtgcgttggtgggagccaaaatttatagcatcaaatacccccttaaccattactcagccatttgggtacgttaatcgaactacgtacagaattatgtgtccaactaccaacccggaggtgggcagatatgaagtggttctgaacccaacgccgcatgttgaggaaccaccacaccctcttccttctaatatgaattttatcatttggaattgtcgactttcataggaactttcgatatctattggattaccatcgcccagccctagtagttctattagaaacctatctcgcagattatactgccattagggatgatttcaattttactaacatggctcaagtgcctactggcactctagaggtgtcattgttctttggctcaatggtttacttactgttgatgaagtggctatggcacattatgaaatacattgcatgatccatgcactacctcttcctactaaatggttatttactgcaatatatgctagtaacatttttgctgatagatgtatactatggaataacttaaattttatttctgatacttataaaggcccttggcttataggggagattttaataaaattctacatgctactgaaaaatttggaggttatgagctaagtatctctagatcaaacaactttcttaattgcataaattactacagcctttcatatttagggttcaaagagagcaaatatacgtggaccaataaacgcttgaaaggccatacaatattggaaagactagacctgcctattggctaattatgattggataaatttattcccaaattcaattgtcaccaatcttcctcgaactcattccgaccattgacctatacaactttcccttataggttttactcctccagccactaaagtgtttaggtttgaaaccacgtgggcttctcacccagatgttagacctgtgatatttgccatctgacaagaaaactatgaccacattaccactatttcttgtttctccaaatccatccaacaatggaacaacaaacctttggtaacattttaaaaggaaaagaatattactttctcagcttgctggtttacaatcttcatgccattacccaatgagcgctttcctctaacagctcgaacaagagcttacaaaagagtacaatcacattcttaaattagaagaagaattcagggccttaaagtcgcgcatcaattggataaatgagggtgatgcaagcaccaaatacttccacttatctaccctccaacttcgtagaaaaatcgaatcgcagttttgcaagatgcagttgataacaagtgttataatttgccctcaatacaagccactatgtggaaacatttcactagattatttactacggaatccgtcttttctcaccgtactttttctaaagccacccaccatgtactacatttagaagaatacaattctcttaataaaccactagaggataggggaattactacaacacttcaatcctttaaatcccttaagggaccggggctagatggtttgtacctttaattttactagcaatattacatgaaattaaaggacttgtactagctatgtgtcaccaaattttcgttacccaatatatccttgagaatatcaattccaattacctctgcctcattccaaaatttaaaaattcggcaacagttcatcaatttcgcccaattagtttatgtaacactatctataaaattattaccaaaattattgttaattgtatcaagccgttattggacatactcatacttcctactcaaactatctttcagcaacacaaaagagcctaagataatgctatcattgttcataatattatcaataaatttcgcactatgaggggtgccaattctagcatactacttaaacttgaccttgaaaaggcatttgaccgcatcgaatggtctttcatcaagtatactctgacctacttcaacttttctgatcccctagtatgctttattatgtcacgtgtctccacctcatcaatatccattttgattaacagctcaccaacgactgtctttcaaccttcccggggtatccgacaaggcgtccctctatcaccatacttatttatcctccgatccgtatggaaattctatctagaagtattaatagtaccctaggctacaactcctggcaccatattttcttatctccaaggggccctccaatatcacatttatatttcgcggatgacattatactcaactcatgaactacctccacttcatgtacaataatcattaacattcttggccatttcttagactagtctagcatgaaaattaattgacaaaaatccgaaaaaataacgaaattctccaataacttcccccaacatcttcggatttcaatcctctagtcattcaacatgtcggaaggcaaatcatttggtaaatatccaggattttccatttttatatattaaaaaacccgcaaaaaagagactttgaatttattcttgataattttaaaattcatttagcagtgtggaaaacaaatctcctcacactggcaggtcgtaccaccctcattcaaactactttaaatgcctgtcaaaccacttcatgcaatacattaagctccctccctacattcttaaatctcttgaacgttaccggcgaaatttactctggggaacaattgaccacaaaaaaagattacacctaatcaaatgggatactgttacaactctaaaatcatatggggttggacatttaaaaaaatccattataaataaagtgctacatgcatcgcttgcgtggaggctcttccattccacctctactttatgggcctccatcctcattttgaagtactgtaaaatccttactaacgttaacctctttaccgtaaaatgacatgggcccttactaacgataacctctttattaaaggaatttttaccggaattttttttctattctataccatatatgaaaccttattacaaaatatgtgcatagtatctaaattacgcgctctgtgcactatttttctacaatttttatactaaaagatagtgctttataaaaatttctctagtaaaatcctcttatattgcctggttaccacccaataccaaaatcctccactacttttttttgcatgtgtgacgacccaaagggtcatcaccggaattcttcttttttccgtactttcgaggccttgaaaacctcgtttttagttgtctcgatttgcgtgcagtccgggcgcgtagccggaaagcttttatgatgaaatatgtgaaatatgtaaaaaatttaaagaattttgatattaatattgttaaagttgactttggtcaatattttgggtaaacggacccggacccgtgatgtgacagtcccgtagggtccgtagcaaaatatgggactcgggcgtattcccggaatcgaaattcgaggtcccgagcccgagaaataaattttgaaagaaattgttcttctaaaactgatatggaattctgcaaagaaaatgagttagaaaatattggtatcggacccgtattttggttccggcacccgctactggtcttaaatatgtgttaagcgctttctgtaaagtttggttaaaaacgaacgtcatttggcgtgtttcggacttaaaatgagaaatttggatttttatgaaaagttggaagaaattatggattttgaggcttaaattgttgtaaatgatattattttggcgatttgatcgcacgagtaagtccgtaggatatttttgaggttgtgtgtatgtttgggttggagccccgagggctcgggtgagttttggataggtgtcgagttgcattcttgaacttgggaaaaattgttgcaagtctgatctgctatctccgcatttaattagaccacatgacaatgtattttactttgtttttgcttttgtatttttctctcgttatatataaaatctaaccctaggcacttgcctagcggatcgcccaaaaaaaaaaaaatcttcgcatttgcgaagtatttctcgcaaatgtgagctcgcaaatgcgagtccaggtccgcaaatgcgagaaagggaacacctgcacagggatcgcaaatgcgaacacccagtccgcaaatgcgataaagagccttcgcaaatgtgataaagggctcgcaaaagagaaagtcccagccaacgtcagagttcgcaaatgcgaactaaatctcgcatttcccaagttagcaggtcgttgcgaaccccagttcgcaattcccatacccggggctcaggaaattcatacttagacgaattttaaacccattttcttcattctttcaaaacacaaacttcataggcgattttccaagaaatttatcttctccaaaccatttgtgagtcaacttttacttaatttcttcaatctttaacatcatttatcatgttttcatcttaaaatcaaggtttttcatgggtaaaaatgcggattttgggtagaacctaggttttcattaaattggggatttggacctcaatttgaggttcaatttcaaaataaatcatagatatgaactcatgggggaatgggtaaccagattttggttcgaacctcgggttttgaccacatgggcccgggggaattttggaaatttttgggcaaaactttaggaaattcattcttatgcattcaaattgatttaactagcaattgttgatacatttgagtaatttgtgactagattcgagcgattttgtggtgaattcgagtggtaaagctatattagaggcttgagttgagtttggagctttcgaggtaagtgtttgttctaaatttggcttgagggaatatgattaggatattatttgctaattgctaaatatggagtgcggtgtataggcatgttgacggttatctatgcaccggagtctagcatgactgtgagtcttaattgtgcttgattcggattttgtgatacatcttccttgtctaattgataagtttcatataatgtgaatggtttgaggaagaattgttattggtatattattggagcgttggctcgaacgagaatatgaaaattgagaaataagtgattaaaagagaaagtgttgtaattgttcccttgccgggacgtgtaattattggttatttccttgccgggatgttttgttgatttgtttgttgatattgttcccttgccgggatattgagtttgttgatatggttcccttgccgggatctatttgttttattgtatccccttgcctagatttcttccactattcgtttatttccttgccttatttgtgactgtggtttaagtgaggaagagtaatatttgaggatcgggttgcacgccgcagcaatgctatctaaggatcgggttgcacgccacaacaatgacaaatgatgaggatcgggtttctcgccacaacagtaatattcgaggatcgggttgctcgccgtaacagtaatattcgagggtcgggttgcttgccgcaacagtaatatttgagggtcaggttgctcaccgcaacatatatatatccgaggatcgggtagcgtgccgcaataaagtatggattaagtgtgcttgatttcagatgtggagtttcctgcttttccttatctgttgttattgtacagtttcatttccttattcgttgattctatatctgaattgtcatacccccacaacatgcttccaccctcttagttgtttaaattctgtatatttttctgctattgcatatatatctgcacaggttgttttcggtagatcctgtctagcctcgtcgctacttcgccggggttaggccaggcacttaccagcacatgggatcaattgtgatgatgctacactctgtgcatctttttgcacagatcccggagcagctttgggacctcagtagtagtattgcttgtgcgctgatttcagtccagggatttccgaggtagcctagctagcgttcgcaggccgaagtccctcctatgtttttagtttgttttctttgtatcgagacaaacattatgtaatttcctttcagacctgtttttagtactctatagcagtccgtgagctagtgacaccagactctgggtagaagtgtgtttcaaacttccgcatcttgtttttagttatataagcttaaaatcttctgttttatttaattgttttcggttatttatatttttcaaatgtcatcagagaaatatttcaaatgtttggcttgcctagctccgatagtaggcgccattacgactcccgatggtaggaaatttgggtcgagacaagttggtatcagagcactaggttacttaggtctcacaactcacgaacaaactcggtagagtctgagggatcggtacggagacgtctgtatttatctcccagaacctgcagagttaggaaaatttccactttgttctttcttgtcgtgtgtttccgtttctcaaataccgattgaatttttactctattctttcgcagatggcgagaacacgcgcttccttttctatcgctcagcagcccgagcccccaacaatagtttccacgaagggcagaggcgaggccgtgccagaggccgaggcaggggcaaagctcaacccctagcagtagtcccagtgacggagcctcagattgatcatggcgaggaggttccagccccagttcttcaggacgttttggtcaggttggtgggctttgtggagagcgtcattcgagcgggtttgcttctagtggttcagccagtggtggcaggtcagccgggtgcagtggctcaggccgggagtgagatcactttccaggagtcggccaatgagggccgtagagttgagatggtactgccacagggaggcggtcatagatcggataagaggccctgtcatgcaggcagattcagtggtacctcgtctggaggtagaggttcttatggtagaggccatccttctaggacctttcagtcagctccccatgtcactcatggtacttcaggtgatcattcaggtcgaaagggccagcctcagtttcctcagctgcagcgtttgtgtagatgttatgagtgtggtgcgtatggtcacctcaggagggcctgcccgaggttgaggagtgctcagccgcagcagtcgatgttttgccatgcttgtggtgattcgaggcacattgtcagattttgcccttgagtttcaggtggttctcagcagtaggatcctcgtcttatgatttaggcaccagttgcctcacagcctgcctagccggctagaggcgggggcagaggacatagaggtggaggtagaggtcatagaggtgaagttcagaccgccagaggtaggggtcagccagcagccaggctagaggttgagtcttcagatgcagatattacaggtaccgttctgatttgtattagagatgctttagtgccatttgatcctggatctacgtattcatacgtgtcgtcctatttttcaccctacttggttatgcctagtgaggccttgagtattcatgtatatgtgtctacactagtgggtgattctatagtggttgatcgggttcatcgtgcctgtgttgtggtgtttaggggtcttgagacccgcgttgacttgttgctcttagatatggtggatttcgacgtcatattagggattgattagttgtccccctatcatgcgattttggattgccatgccaagaccgtgaccttggctttaccagatttgccccgactagagtggagagggaccccatgttataccactcgcagtgttatttcatatgtgaaggctcgatgcatggtcgagaaggggtgcttagcttatctggcgtatgtttgcgactctagcacagaggtcccgtctattgattcagttcctattgttcgggagttccccgaggtttttccttcagacctgccaggcatgtcgcctgacagggatatcgatttttgtattgatctggctccgggcactcagcccatttccattccgccgtatcacatggccccaccagatttgaaagagttaaaggatcatctttaggatttgcttgagaagggtttcattagacccagcgttttgccttggggtgaactagtgctatttgtgaagaaaaaaaaagatggttcgatgaggacgtgcattgattaccggcaattgaacaaggtgacgattaagaacaagtatccactgccgaggatcgacgatttattcgaccagcttcagggtgcgagggtgttttcaaagatagatttgagatctggctaccatcagctgaggattagggcgtctgatgtccctaagacagcatttcacacacggtatgggcattacgagtttttggtcatgtcatttgggttgactaattccccagcagtgttcatggagttgatgaaccgagtgttcaggccgtacttggacttgttcgtgataatcttaatggcgatattcttatatactcccgcagttaggaggagcatgagcagcacctcagggtggttcttcagactttgaaggatagccatttatatgctaagttctcgaagtgcgagttttggttgagttcggttgcatttctgggtcatttcgtatcagtagagggtattcaggtggacccgaagaagatagaggcagtcaagaactggcatcgaccagcttcagctacagagatttggagtttcttggggttagcaggttactaccgtcggtttgtggaggggttttcatccattccagccccgatgaccaggttgacccaaaagtgtgcccagttcagatggccagacgagtgtgaggcgagctttcataagctcaagacggctctgaatacggcatcggtattggttttgcccacaggttcagggtcatatacagtctattgtgatgcttcccgtatcgggtttggtgcagtattgatgtagaatggcaaagtcattgcttatgctttgaggcagttgaagttccaagagaagaattatccagttcatgatcttgagttggcagccattgttcatgctttgaagatttggaggcattacctatatggtgtgacgtgtgaggtttacactgatcacaagagtcttcagtatctgtccagacaaaagagttgaatttgagccagaggaggtagttagagttgctgaaggattatgatgtttctatcttgtatcacccgggaaaggccaatatggtggccgatgctttgagtaggaagtccaccagaatgggtagccttgctgatattccagtcagccagagatcacttgctttggatatttctgggcctagcagagtgttagcttgcatggttgctcgatcttcattgttggagcgtattcgtgagcggcagtttgaggatccctatttgtgggtcctgagagacacggtgcagcgtggaggtgccaagaaagtgaccttgggagatgatggtgtattaagattgcaggggcgagtttgtgtgcccaatgttgatggtattcgaaagttgatcttagcggaggcccatagttctcggtattctattcacccgggcgccgcgaagatgtatcatgatctgaggaagcactattggtggcgtaggatgaagaaggatatagtagcatatgtggctcgatgtttgaactgtcaacaggttaagtatgagcatcagaggcccgatggttcatttcagcggattgagcttcccgagtggaagtgggaggggattaccatggatttcgttactggccttccaataactcagaagcagtttgatgcaatttgggttattgttgataggctgaccaagtcagcgcattttgttcctgttgtagccacctattcgtccgagaggttagctgagatttatatcagggagattgttcgccttcatggggtgcctatatctatcatttcggaccggggtccgcagtttacctcgcatttctagagagcggttcaacgagatttgggcacccaggttcagtttagtatagtatttcatccccagacggacggtcagtccaagaggaccattcagattctagaggatatgctccgagcctgtgttattgattttggaagctcgtgggaccattttttgcctttagcaaattttgcctacaagaacagctactagtccatcattcagatggctccgtatgaggcgttgtatggtaggcagtgtcggtccccagtcgtatggtttgagccgggagaggctcggttattgggtacgaatttggttcaggaggccttggataaggtccggaccattcaggatagacttcgtacaactcagtccaggcagaaaatttatggagaccgcaagatcagagatgttgccttcatggttggtgagcgagtattgctccgtgtatcgcctatgaagggcgtgatgagattcgggaagaagggcaagcttagccctaggttcatcggtccatttgagattcttgatcgcgtgggagaggtggcctataaacttaccttgccacctagtttgtcagatgtgcacccattgtttcatgtatctatgctccggaagtaccacggcgatccatcgcacgtgttagatttcagcactgtccaattggacaaggatctgtcttatgaggatgagccagtggctattctaagaccgacaggttcgacagttaaggtcgaagagtttttccttcagtgcgtgttcagtagagaggttagcctcctgaggcatcgacctgggagtccaagtcggatattcggagccattatcctcatctatttcccgactcagatacttctttcttttgtccgttcgaggacgaacgattgttttagaggtggagaatatgacgacccaaagggtcatcaccggaattcttccttttccatacttccaaggccttgaaaaccacgcttttagttgtttcgatttgcgtaagcagtccgagcgcgtagccggaaagcttttatgataaaatatgtgaaatatataaaaaaattgaagaattttgatattaatattgttaaagttgactatggtcaacattttgggtaaacggatccggacccgtgatgtgatggtcccggagagtccgtagaaaaatatgggactcgggcgtattcctggaatcgaaattcgaggtcccgagctcgagaaatgaatttttgaaagaaattgttcttctgaaaatgatatggaattttgcaaagaaaatgagttagaaaatatttgtatcgggtcattattttagttccggcgcccggtacaagtcttaaatatgtgttaagtgctttgtgtaaagtttggttgaaaacagacgtcatttggcgtgtttcggacttaaaatgagaaatttgggtttttatgaaaagttggaagaaattatggattttgaggcttaaattgttgtaaatgatgttattttggcaatttgatcacacgagtaagtccgtaggatgtttttgaggttatgtgtatgtttgggttggagccccgagggctcaagtgagttttggataggtgtcgagttgcattcttgaacttgggaaaaattgttgcaggtctgatatgctatcttcgcatttgcgaagtatttctcgaaaattcgagtccaggtccgcaaatgcgagaaagggaacacctgcacagggatcgcaaatgcgaacacccagtccgcaaatgcgaaagagccttcgcaaatgcgataaagggctcgcaaatgcgaaagtccccgccaacgtcaaagttcgcagatgtgaactaaatctcgcctttcccaagttagcaggtccgggttcgcaattccatacctggggcttagcaaattcatacttagacgaattttaaacccattttcttcattctttcaaaatacatactccataggcgatttttcaagaaatttatcttctccaaaccatttgtgagtagacttttacttaatttcttcaatctttaacatcatttatcatgttttcatcttaaaatcaaggtttttcatgggtgaaaatgggaattttgggtagaacctaggttttcattaaattggggatttggacctcaatttgaggtccgatttcaaaacaaatcatagatatgaacttatgggggaatgggtaaccgggttttggttcgaacctcgggttttgaccacgtgggccacggggcgttttgggaatttttgggcaaaactttgggaaattcattcttatgcattcaaattgatttaagtagcaattgttgatacatttgagtaatttgtgactagattcgagcagttttgtggtgaattcgaggggtaaagctatattagagacttgagttaagtttggagctttcgatgtaagtgtttgttctaactttggcttgagagaataggattaggatattatttgctaattgctaaatatggagtacaatgtataggcatggtgacggttatctatgcatcggagtctagcatgcccgtgagttttaattgtgcttgattcggattttgtgatacatcttccttatctaattgataagtttcatatattgtgaatggtttgaggaagaattgttatttgtatattattggagtgttggctcaaacgggaatatgataattgagaaataagtgattaaaagagaaagtgttgtaattgttcccttgccgggatgtgtagttattgattatttccttgccgggatgttttgttgatttatttgttgatattgttcccttgccgggatattgagtttattgatatggttcccttgccgggatctatttgtttgattgtatacccttgcctggatttcttccactgttcgtttatttccttgccttatttgtgactgtggtttgagtgaggaagagtaatatttgaggatcaggttgcacgccgcaacaatgctatctaaggatcgggttgcatgccgcaacaatgctatctaaggtgtcacgacccaaattccatacctgatcgtgatggcacctctcgtgaagacaaggccagccaactaccccaaaacctctctttaacaaatttgtaaacataaatgagtagaaaatacaacataatggcatttgaaactgtttatttttatcccaatacatcccgaccggggagtcacaagtcacgagcatctaaagaagactgaataccactactggacctatactagatataaagtacaaactggagttcaaagatgaagtccgatgccgcgaacgctggcggtcaccttgctcagctacgatagtaccttcaatccactaataacccgctttcgagaagcaatacctgcaactgcacacgaggtgaagggagtcgggtgagtactaccaactcagtgagaaataagtacagaaaatgtctgaagataagactccccgtaataccacaatgtaaagctaaaactaatagtctaacataattaacgaagaaacaatagcagatcaatatcagacaagtataaatgtatgaatgcaatgcaatgcaatgcacatgaccattgtggcgtgcagcccgatccatctgggtacccgcgctcactaggggtgtgtacagactccagaggggctcctacaacccaagtgcaatatcaagccatctcgtggcatcattcaaatcctggtcagccattgttacctgacccatttacatcatacagtgccattgttaccactgtttcaaatcactgctgcggcgcgcagcccgagccacccataatgtttcaagtcacatcacacagtgccattgttaccactattttaaatcactgctgcggcgcgcagctcgagccacccatagtcagtccagaaaatatcataagcccattgggcatttataaaacaatgatcctcagccgaaataacatttagaaatagcagttgagttttcaaaacttagaaatacggctgggtttgcaaaatagtatttaaaaccatggattgagagaaatatatgcaattcatgcaaagacaattatatcaaaccccgaagggttctgcaagtcggcacgaggccccaaacaatggcaacaagcccaaatactatcaatacaatgtgtgtatcagtcgccaatatatttattaattatccctcaggatggaccaagtctcaatccccaatcatatacgatcccacacctgccatggggtgcgagtcacgcactaatatagcgtcacaatgtgataaaccggggtttcaaatcctcaggccatcatctataccgactgctcacctctaaccggccgtagactggtccgcgataccctttcctcttgaatatacctcctcgcgcattgaatctagtcaaaaccacaacgaatacaaaaatatgggctaaagaaacataacccaatcgaaaataatcgaaaagcatcaataatcccgaaattgacaaaacccgagccccgggcccaatttttgaaactcagaaatttttacataaaagtattcttcatcttctcccgattccgtacatataaagaacaccaaaatcggagtccgtttgacccctcaaatcgatccctaaaggtttcataatctcaggccacaaaatcctacttttctactgtttttcatgaattaaaggctgggattatggtctataatcacccataaatgagttttgataatcaaataacttacctctgcgatacccactgattttctctcttacaaatcgcctcggaagcttcttcccgttcaaaaattgaaagaaaattcgacctgctcattattttttttttctttttttttggcaaaccgctaggcatgtgcctagggctaaattttattaataaaagacaagaaaaatacaacaaaaggacaagtagaaataagggggacaatagcgccggtgttgtcgcctatatcaaggcaacactaactggactagaccttaccttactaatcctattgaggcctaaaatagcctccttagcaagcatgtagaaagaaagagctagctagaactaagtatcctatgatcatgacagagtttataacatactctgttatgatattacatagaataatactaatgtgatggtaaaatagaaagatgaagaagccaccatgatgctcccttttctctattcttgtgaacacttctatttgtaaattcttgtcttcgtccacaactcttttcaaaaagtcttcaaaggtcatgtttttttcttcaaacgattggactttgtggatgtagtattagtgatttgtttttgttttgcatttctcattggaagtctccttatgtttgcttcttcatttactctaccctcccagctcctatctcttgttcgagatttcctgccttttccgctatgcataggtgataaatcacctttccttgccgcttcgtccctacactgttgtaacaaagcatcctcttcaccctgttcaaacatttctctcccctgattgacaggttgtgggaagttttggacattatcaagtgtcgccaaggcagattctctatgtaatgttaccaccattgtttcgaaatctgcttgtgcttctgatgtttgttcttccaaaactgtcacaactggtgtgatctgccactgctgtccaggcgacacttctgaattcaaagaagtaatgcttggaccagtcgattgctgccttgagctcgggataaaaactggagctgttgcatttagttttccaacaggtcctaccttagcagagctaccaatttcaggaattggagacactattgatgccatctcctcatcaccactacatatgtcgctatcatcagaagaatcgtccacaaaatcaattcccaaatcttcttcatcatcgtattcacgttgttgaacccatgtcaaggagtttgttgctgtctcccatgcttttgcgtcttcatcatcattctcttcatgttgttgtaaccataatttagatttgatcaccttttcagcgaccaaattaggatctcctgttgctcgatcagcttgcacaggtgcaccattagcaactgttgctcgacctgctcattataggtatattgttcacgcgttttactgctcccaatgaattccttgtgaaattctaatgaatttaggcttttgaatcactcaatttgaccttataatgaaggagatatgtaggttttaagatttgcaaatagggcaggtttttaatacgccgtcaggggcaatttcgtcattaacttaaaaatctgggcaaccttggtaaaacggccataagatcctcatacgatgtctaaattcgacaattctttttgctacgggtccataattacgatacggatctagtgcttcattcaaaacagtactcggagctcatttgttcaatatgatatcatttatatccaaagaaacagcgttgaaacatcaaataagagcgtgattacaacccgaaacacacccggggtccccgggaccccaaccaatcactccacccagtcccaaaatacattacggacttgctcgaggcttcaaatcacatcaaacaacgctaaaatcatgaatcaacctccaatccaagttttatgaactttagaatttccaacttctatttctgatgccgaaacctatcaaatcacgtccgattgacttcaaattttgcacacaagtccaaaatgacataacgaagctacaaaaattctcggaattccattccgatcgtcggatcaaaatttcacctatcaaccggaattcgccaaaatactaacttcgccaaaataggctaatttcttcaccggacctccaaaattcattctgattgcgctccttggtcttaaatcatcccccgaaactaccgaatcatcggaattcaattccgagccctctaactcacaagtcaacatccggttgacttttccaaactaattcttccttaaagagactaattgtcccatttcctaccaactcaatccgaattgactcaaattcacaaagtacacatattggaacatgagtaagcatataatggggaaaacgggatggaaatacatgagacgacgggtcgggtcgttacataaggatcgggttgcacgccgcaacaatgacaaatgatgaggatcgggttgctctccgcaacagtaatattcgaggatcgggttgctcgccgcaacagtaatattcgagggtcgggttgctcgccacaacatatgtatatccgaggatcgggttgcgcgccgcaacagagtatggattaagtgtgcttgatttcatatgtggagtttcctgctttttcttatctgttgttatggtacagtttcatttccttattctttgattctatatctgaattgtcatacccccacaacatgcttcccccctcctagctgtttaaattctgtatattttcctgctattgcatatatatatatctgcacatgttatttttggtaggtcctgtttagcctcgtcactacttcgcctcgccggggttaggccagacacttaccagcacatgaggtcggttgtgctgatgctacactctgtgcatctttttgcacagatcccggagcagctttgggacctcagtagcagtattgctcgtgcgttgattttagtccagggatttccgaggtagcctagctggcgttcgcaggctgaagtccctcctatgtttttagtttgttttctttatatcgagacaaacattctgtaatttcctttcagacctgtttttagtactctagaacagtccgtgagctagtgacaccagactctgggtagaagtgtatttcaaactttcgcatcttgttttcagttatataagcttaaaatcttccgctttatttaattactttcggttatttatattgttcaaatgtcatcagagaaatgttttaaatgtttggcttgcctagctccgatagtaggcgccatcacaactcccgatagtgggaaattcgggtcgtgacagaatgtaccaatgctaaaaccatatggtcacagctaaactttttgcaagaaataaaatgtaactctagtaaccatactagccggatataatggctatacaccatacttcacttatggaatactcacttcccaaattctctcccttttgtctctggtacttccaaattatcattctataaaatttctacctcacaaattatacaccaatctccaaaatctgaaaaacaaccatgtttatttttccagcgcaatattgttttgtgtaaacatatcaaaatatatatcctttgaaaaccaacacaaataaataaaaaaaaactttacattaaattatgatgataggctataattacgtattttagtcgcttattacactcgagtttactgcactttaattgagtttgagctttaatcgctagtgttttgcgcaattgtgtgttttatgccttgtaggtgcgattccgagctatatagatgttatgaaatgaatttaagtgatttgaagctttgaagtctgagtaaaagctcaaggaattaagccgggatcgtgttcggggatcaaatttgatagttgagaacaaacgaagaatcgagcgggcatacggcgcattttctagcaaaatacacataacttttcgctcagaactccgtttgggctctataatatatcgttggaaagctattcaaaagagctacaactttcatcttttgagtttcagataattctcactatcgcaccgcatggggacgccgcacccatgcggcacgacatgccaaattttacagagctgtcctatttcgcacaggaaagggttttttcgtctgggcccgaccctacttggtataaatacatgtaaaaatgctattttgagggatagtacatatttttgacatagaattgacctaaggagtcaagaacacaatagaagcaaggcagggaattcttcaacgagtttttctttcctcttcctatttttcattattggttatgacttttagtattgtagttttacatactattatgaatagctaatttgttatctagagttttgataaaaccttttgtaggatgaattcttgttatgtttttatataattgagccatagttttctctgtttgttcaactacgtttatattgtggttggttgaagagctctcaattagctgtgcctatttagtatgcataactcgggagagagtgcatatttaggtaattgtttaacaacaccactcccaaagtatatgagggatcaataactgcgggtttaaaggcgggattagggataacgaagccttgggtgcgatctgaagtgagctgtattaaaagccaactagcgtagctcgggagagtgcgtctagtaaattgtcgtgattacttgggagagatttacagtaataagagtgctcatgatcggtagagaatacttaggcgagattatagaagacatagcgggaatgattccaacaattggggaaatcataactctagacctccttaatcttgtctctaacccttagtatctttagttgttaatttacaattttattttgttagttaattagttcaacacaagaaatctaaatatctataagttaggaattgttcaagcttgtcttcttggtaatattgaacagctgttgctaaaccttagttctctgtgggattcgactccggacttgtaaaccggattatatttgcaacgaccgcattgtccttttataaggcatagttgggcgtgatcaagttttggcgccattgccggggacttaacggtgtagctgtagctgtacatattactaggtttcaagtttgaacttttatttttattattgtatttgatttttttcttttattttttgttttacttgttgattaaaaaaaacatgacatcatggaattataaaagttttgatgttggtaattctacttttaatcctccttatgcatattgtgatgaaaaccacccttggcaaaattatcaaaatatttccgagagcgagttttgtgcaccaactcaatcttatgtgtggaatgtgtgtgatacgtgtggtggtcaagatggtcactttcatgattgtgcttatatttcttgtcttctcccaaccccttattatgatgattttacgttttcttgtgaggataacaggaacaaagaacctagggaagctgacctaaagaagattgaagatatgttaaagtgcattatagaacaacaaagtaaaatacaactgcagatagaaaggcaagatgaaactattcacaacttagaggctcaagtgagtcaactagttgaatattttaatactcaatatgtcaatattatggatagtagccaggagcagtttgcattagagacgaaaattgaggtgccaatggaggggtccaaagtagaaccccaacactctaaccatctagaatttgaggatgctgacgttgaagaagtaatactagagtcaaccaggaacgttgacgatacaaatttagttgactctagtgttttgggtattgaggaggtcgaaaatcttgaagttcatatattagagcgtgttggacctcattccaaacacttctctacattatgtttggacggtgaaatgggaatggatctttacgagcataaagaggagtccaaggaagaggtagatgggccttatattttgaaattttcaaggccgtctaggcaaggtgactctcctcggtcgagagccaaaaagtgcataagactctatctaatttttggctcgcaagaatttgtaccgccccaagagcataatcataagcttgaagcaaaacttggggtgcgattcataagttcgaagtggaggcagaaagtgagtcacgtcccgccgcgacgttaaatcaagcacttgttgggaggcaacccagctgtactatttttattttttattttttgtattaatttttttttattgtattatttttgtagtgtcaattttttttaggagcatggaaagcaaaggtattggaaggaccaagcttgggagaagtctgagtaccccatgagctgttagtgcttcggcctttggcctaccagggagtctcttttacccttttattagttatggtgtgcattggggacaatgcacaattttaagtgtggggtggggagatcgtttggatgactttctatgctattttagttgtgttagtttaattgaataatttttttttaaaatagaaaagattggacttttcccgacgatggatctattagacaaatttcttgagggatttaagtctaaagaaaaagtacaaaaagattttcttttgttaggtagtgtaataattaccccttggtttttctttaaaccacggttctttttcaagggttttatttgaaccgggtgtagttagtttttttttggaagtaggagccattgtgttgtgttttgaattgaagcaatatctcttgactttgttataccttgagaatagtgagtactttggttgtgacgcttaagctcagtttttgactcttgtataagtaccttaaattgtatgttcttaaaattacttaactgctttgactagagtgtccatgaatccaatcctgagtgagttatgcgccatgtgtgtgtgcggtttgttgtattctgtgcattgcatttgatgcctagaacttgccccgtgtgtttgcaaagtgaaatagtagttttattcaatctaggaagtgatataggcatttctttgttgagccagatatgtatattttacccacctaattgttatgtatcgtagttaacccatttgagcctataatccttagtctttggcaaccacattacaagccttgcccatttgtttgaattaaccatctatttgaaccttttcacctctcgtgagcacttgaattgttataaactttgcaaaagttaaagtgtggggtggttgttttggcttttgagtggaactaatgaaataaggagaaagggtgcattgatttgaaaaacaagagccacttgaattgaaaaaaaataaaaataattagttgtattgttgtaaaaaaaaaatatattctttgatggtggtgactcttgatataattgtacttaaataatttgggagttgatgtatattgatgtgaaggtggagtttggcttgacataagtatggggtttgaatgttaaagtatatgtattaaagtgcttagggaggtgtagtcactcttatatctaaatgtatcctacccgtcccgtagcttacattacaaccaaataaagtcctaattgatcctagattgaatgagctcgattagtggagtagtacactacgggcaagcttatggtgcatcttttgtggcatatgaatgttatttctgagagtgagtgaattctttctatcttgagttcctaaatgttcttaaaaattgattgtgtggaactactctcttttcgttgtgtgagggcacttgattcatgaaggaaaggtaatatcagtgacctctatgttagagtaagtaggtgagttgtgaataatgcgtggtacttgtgagtcaaatcttgaggtaaagatgttacgcttttgtgcttagtttattttaaatactcttggtgtgatgagttaggagaattgtttaaaaaggttgtgtctataaaaagtatagtttgattgctcgaggacgagcaatgatttaagtgtggggtgttgatgataggctataattacgtattttagtcgcttattacactcgagtttactgcactttaattgagtttgagctttaatcgctagtgttttgcgctaattgtgtattttatgccttgtaggtgcgattccgagctatatagatgttatggaatgaatttaagtgatttgaagctttgaagtctgagtaaaagctcaaggaattaagccgggatcgtgttcggggatcaaatttgatagttgagaacaaacgaagaatcgagcgggcatacaacgtattgtctagcaaaatgcacataacttttcgctcagaactccgtttgggctccataatatatcgttggaaagctattcgaaagagctataacttgcatcttttgagtttcagctaattctcactatagcgccgcatggggacgccgcacccatgcggcgcgacaggccaaattttacagagctgtcctatttcgcacaggaaagggttttttcgtctgggcccgaccctacttggtataaatacatgtaaaaacgctattttgagggatagtacatatttttgacatagaattgacctaaggagtcaagaacacaatagaagcaaggcggggaattcttcaacgagtttttctttcctcttcctatttttcattattggttatgacttttagtattgtaattttacatactattatgaatagctaatttgttatctagagttttgataaaaccttttgtaggatgaattcttgttatgtttttatataattgagccatagttttctctgtttgttcaactacgtttatattgtggttggttgaagagctctcaattagctgtgcctatttagtatgcataactcgggagatagtgcatatttaggtaattgtttaacaacaccactcccaaagtatatgagggatcaataactgcgggtttaaaggcgggattagggataacgaagccttgggtacgatctgaagtgagctgtattaaaagccaactagcgtagctcgggagagtgcgtctagtaaattgtcgtgattactcgggagagatttacggtaataagagtgctcatgatcggtagagaatacttaggcgaaattatagaagacatagcgagaaggattccgacaattagggaaatcataactctagacctccttaatcttgtctctaacccttagtatctttagttgttaatttactattttattttgttagttaattagttcaacacaagaaatctaaatatttataagttaggaattgttcaagcttgtcttcttggtaatattgaacagctgtagctaaaccttagttctctgtgggattcgactacggacttgtaaatcggattatatttgcaacgaccgcattgtccttttataaggcatagttgggcgtgatcaaattacatatttgccaaaaggtatatttttcaaattaaactagacaaatgtgacatcaacatatcaagtttcccaagtcgtcaatttcatttttttttcttaataaaacgagtggagaattacatttacgttgttgttttaagttttttcttcatgctgaatagtaacatttatttattcgataccccttctatgaatttagatgcaaaacagcgtttcgaattacgaatgcataaaacatagtgtttcactatttgtttatcctaaaagatggataacaattagatttatatatgattttaaggatatgcagattaattcgatacaaacgataaattgtgttagattaaacagataaagaacgtaataaattgtcagaccgattaaggggagtgaccccggactcactaacaacttaatgaaatgcctgccttcgatcccgggcacacactaatgaagaattcatgaacaaaagcaagaactttgagcaatagagaaaataagagtatattgctatgcgtattacaatgtgtttatgaatagtaaactttcccctttatatagtaagtgagttttatcctaattaagtacaattctaaaaaagataaaaatcttcgcttcgacgatcactgattttttgccgatacaagtcgagattcacgccgtgatattccgttggctacagatatcacaactctttgttagtcgtgtgcagctgctcggtgatgctctccgatgtctcaacccttaaatcgaacctcgaggatatggccctgatatccccgagggcaggtgttttcccgtgccctgatacgaggggttcttcgttctaactctgatacgttacggtcatcttcccgctctgcttggctcatcgtgaagtcgaatcatgcaacaaactcggttttacccatgtacactatcattgacggacttagcaatgaatcgtggaaccgaaggccaataaataataaaataaaataaatcaaacagtagataaaaaaattatgaagaataaagatattatactgaaaactaaataattttcaaaataaaggtagaatagttcactactatctaggcctatataacattactctaatttctaaactgtagaacataatatacaagtttttgtaatacttaaaagaaaacctaaaaaagaaatattgattggagcgtacatgacaggtaatgcaagatgtaataccaacttatatattaaatcattcatgtacgagcatcgaatttatattttttaagatgaagtaaaatattttaggtcgtaaaagtcggaatggtattcacgtcaattacaatcctgaaatgccatgtgcaagctatcaaaaaggtggtggataaacaaagaccgtggaaggttggaagaggtgtgtccttctggtttgacaattggtcatctaagcttggtcctctttgtgactaccttcctctggatcataaacttaataatttgaagctcttagatatgctattgaacaatcaaattaactgtgagggttatgatcaacttcttcctcaacttattgtacttaaagtcaatagtctcgagatccaactgaatttatctactcctgataaagcaatatggagtgcgaataacaatgagacttattcagtggcatcagcctggcatttgtttagaaaaaagcaacaaaaggcttgggttaatgctatgaattggtagaaaggtattcccttcgagattaacttcattgtatggagggctttgatggacaagatatcaactgatgcgagagtttctaagttgggttatcctacatcctctagatgttgttgttgtggttctccaaaggtagaaaatgttgatcatttattctgcactggctcattcgcaaagaatatatgaaaattattatttggtcctatgaaaattgcatacagtgatatatctttcagataacttatagtgaactggtggaggtacaaggtaaataatccaattcaagcattcattattaaatgtttgcctgccattgcttcttgggaaatctggagagctaggtgcaatgccaaatatgataatgttagagctcatctgagaagatctctttctttgattgctttctctgttgtacaattggtgaacagtcaattccagcaggaccaattgtgtccacattgggatgatatccgtcagataataaggagctcaatttactttgaaaaatccatggtggttaaatggatcaggcctaccattctttttctcaaacagaactggtagttgcaaagaagaaaattgtgatggtggaggtgtgattagggacaaaaacgggtgctcaatttttgcctactccttatctctaggcatagatactagcaactaggcagaaacttctgctcttcattatgacataaagtagtgcatgttaaatggagtggaaaatgttaatgctgagagtgattacaaattgcttgttaattgtgtaaatggacattgtacagttccctcgaggatatctaagaagtcgaggagcttgaataattcaagattcagtcaagctatagtcttaagcatcattatagagagagataaatcaaattgctgataaacttatcaattatagccatactctcgttcattctaaaaagtttcatgaatttgctgaattccctcctcaagttcgaggcctgatgaatatggatagatggcctttctcttcttttcgaaggaccagactgaagaaaggtaccatttcatttcaaccaccatgatcatcatgtttttgtataatagtaaggtagttagtcctagaggtaacttttgtataggatggaatatttatatatacttcacaatgttgttgccttccagctcaaatgcatttacctcatctcaaaatgtaaaaaaataggtgtatctatctttcaagatgaactagggaggagatgttgctactccctcagctcaatgtaatattcttttggaaatgaacaaaatgcaatgtttgtattaataaaaacgcgtgaaaactcatgacaatttaaggtcccaagaatgcctagcataagtggcaagggcacaatatgcattatgggttcgattgaactcgataatttttaccaataatataagtagctaggttgttgattctataacaagcacattggtttttgtcttaaaagagaaccatagttgttttatcaattttgtgccaagacctaaccacaaaaatgctgcccaacttttaccctcacactactttaaataaagtaaattagccatgctgctatgccttcatgcctttaacctaattaaacctttaaattaatggcggagtaacaagaacattataaactcatttcgaaattcttacacaaatagtgattaattaaattttttctcttgcttttctaaagaatttatatgttgcttcttcttttcttaattgaggagtgaggttggaagaaagggatagataattatttttaattaatcccttaactaacgcgtgattatctgtgattaaccgctagccaaaggatagcattattcgaagtaaaggtatagtatcattcgaagtagaacaaccattaggcttcagtttgaaacaagttagcatattcggctgtagcttgtatgaatcttcattaatcatatttttccatttaaaaatagctcagcctacactgtaggaaataaaaataaataaagagaacaatacaaacaatataaaatatggaatttttcattttttgtagtactagtttttggatacgtacgttgtacgtgtatcccgcatcaataaatacaaacaatataaaataacaacatgaatatcggataagaaagagaaatatgcatcaacgtaaacctaaaatacaattaacaaacaaaaatgctagctactgatgggggagaaaataggacataataaatcttttcccatcccaatgatatttatattttgaaatttcatataattattttccatacaagcaattataacatgaatatgcatgcagtttgtgagcaattcagtcttaataatcaatatttttacaataattgcaaaggccagttgttagtacgactttgtaaatgttagccatgatgaacttaccaagaccaaatattgtgtctagtccaagatcatcatcagaatgaatatatggatattcatgatataactataattgcaagcatctcaatattccacctaaaagcttagagaaattttaaaatactaaaaataaagcgaaagacgtacaacaaacccataaaaatacagacgtttgaagactccatttcatgttttgtgtttcatacacattaaaaatactttgtatctcatatagaatgttatcaattgtccaattctccactttcgttatttgatagttgttccttgcatatacatatgttgctacttgcaaattttgaagtactctgaataataacttgacgtaggatttgatgggttatgcaagctaattaagaggtagtattaaagaaataactaaggatatattagacagcggaaagaagaagaaaaattaactattgagttctttatactattgcatatataataataaaaaattaaattaataaataaatcattaagtagagggtggtttagtcattcagcttttgaagtattttagtaacataacttaacctaaaaaatttcacacttataatatagtatgattattaataatttggtcaggttttctaaggtaaccgttcgagtcgtggaatcaacagttgatatttgtgttagagaaggctgcttacattatactctttggggtatgactcttctccaaatcctgcatgaacaggaaaaacttcgcacactaaattccccttttttaaaaacgtttgttgttgagaaggtcattgaataccaacaacacaccaaaaaaaaaaaaattcagtaaaatcctacaagtggcatctgggaagagtattagtatgtatgtagatcttacctgtaccttatgaaggtagagaggctgtttctaaaagaccttcggctcaagaacattaaaaataaagcaatagagaaacaatagtaacaataagataataagacaatgaaagtaaataatacaacaagtaatataataacagcgatccagggatatgaaactataagaatagtgtcaatcctacttacaatggtggaccttgaatcccacgatagggccttataatgatcttgttgtttcatattgtttagagtgcaattgttgtaatccctgatgaaaactgaaggatcatattcctccttagtatactacatatatactttgtcaaataacatgagattagatcaagaaccatcactttctacttttctcataatatatactacgagtttttagaaaaattatatttaaaaaaaaacagaagttgcaatgtctaccactcgtatggtacagaggttgatccagaatttaaattttatgggtttaattttaatgttcttagtaattaaactcattatatcctaaattaaagttatgggttcatatctataatttattgcgattttagtggtttttgtacataaatttgtgctttgagttgaaagttatgggttgaacccggtgttatagagctacatccgcccctatatgtgtaaatatatcgaggtaaatttcacaaatagtcatataactatgattttttgttaccaaagttatattgtcacgaccccagttcaccctccgtgaacatgtcgtgatggcacctagtcgctacgactaggtaagcctaacaaatgcggaaattaaaccaattgcggaagaaaatattttaaactgaaccaaataaataaatcaatgttcaaggtgccgcctggcacatacaacaacaactctcataactaatcaaagttcccaaaatccggaatctcacaaatcacaagctaagggggaaggggggggggggggggggggannnnnnnnnnnnnnnnnnnnnnnngggtacataagaggctctgactcaagaatatctatacaaaagaaaatactggaagaactatacttttatagaaaagctggaaagggactcctcggtctgcggacgtagcaggtatacctcgaagtctctaccgatgcacctcctttcaaggctgacagaactaaatgagagtacctgtatctgcacaacaaaagtgtgtagaagagtagcatgagcacaccacaacggtgcccagtaagtatcaagactaacctcggtggagtagtgacgaggaacagtcaagacacctaccggtcaataaacagtataatcataagaataacggaaaagatatatagttatgtaaagactgcatgaatgactaaaaaatactacaatttaccataaggaaaaaggcaacatgtaacaatgggagtaaataaatgatgatacgaatgacagccgaattaccatcagaatcctaaggtcacaacacagcaaagacaacaagtcactaactcatattctacaatgacgcttatatacggtcttactcaacaccttccacaattattaccaacatctcggaccagccacaactcatgaaaactcagcatctaaagtctaacacttgacatcttatgctacataaatctcatggtcatgctgacaactagttagtcaactaaggtcaccctcacacatataatgggtaaacgggggcgtatctccacccctaaccaattcaggaggaattcatctctaataggagtgcccaactacgtgtatgcttgtgcaagtgtaattaacaataattctaccaactaataagtataagaaatggaacggccagcacctgaattatccacactcgtatagaatcaataaaaatatcagttcagaacacaatgagtttaacggggatctcccaggatatcgtcctgtagtcccgaacaaaaatatgtgtgttagggatctcttggtatcctcaatagatgtactagggatctcttggtatcccgaggatctcctggtatcctcaatatatatatatatatatatatatatatacatatatactagggatctcttggtatcccgaggatctctcggtatcctcagtatatgtgctggggatctcttggtatcccgaggatctcttagtatcctcaatatatgtgctggggatctcttagtatcccgaggatctcttggtatcctcaatatatgtgctggggatctcctggtatcccgcactacaacagcatcaacatagatgtacaacccaaataatagaatagcaacctcccgacaagggagtcaacaatagaaaatcataacatcccagcaagggagtcaacaatagaaacaataatgtcccggcaagggaatcaacaacataaataataacgtcccagcaagggaaataaacaacagaaacaataacgtcccggcaagggaaatcaacaacagaaataataacgtcccggcaagggaatcaacaatacataataaggtcactgaacaccaaggaagcacaataacctcaacgacataacaagatatagcaattgtgtaatagctacaccgggaaccacaacagttggacatgtaatatatttgcacgaagtcacagatgaacttacaatcaaggagtatctaaaccacgaagaagtgaacataaatcaaataattacaattaaggaattatcaactaaatatgggatatctaacttcttttcaattaaggccagttaagtacctgagaagtagaataacaatttccaattaaagacaagcagttaggagagataacgtggttatataagggtaaacgtttccagctaaacaagtagaagtcaactaggaagcaagaagaaaccaaaagggcaaataaattccaagtaaggcatgtaggagtgaaactaataacagggaactcaatcatctcaagaacaacttcatactcagtgatttcaagggtctaagagcctaaaaggatcaatttaccacaaataaattcgagcacacactcgtcacctcgcgtgcaaggaatacaatcaacatagaagactcaaatcctaagagaagtccctcacacaaggttaggcaagatacttacctcaatccggtcaattcaatactcaatttagcttttcctttaccaattcatcaatgttcggctcaatctagccaaaaacaacttgaatacatcaaacagtgcaagagaaaataatttcaattgacaaaactatgattcttatacaatttgcaaaaagtcaactctccgggaccgcacctcggaacccgacaaaatttacaaaaaccaaacacccattccgttaaaagttatctaattccgataccatttggtcatttaaatcatcattttacatttttgaaagatttcacaattttccacaaattttcctttagattctcttgaatttgatgttaaatctaagatataatcacagaatatagttggaaatggattagagacacttacccaatgatttggagaagttttggtctttggaaaaacgcctttggaaactctagattatctatcaatccaccaacttgattctcgacctccacacctttctatcgagggtcatatatatatacatatatatatatatatatatatatatatatatatatatatataacaattattaacggaacttaaaaacaacaagcatgtcataacatttatttttcccaaaataggttatcttaaagttgcccaaacaagcacataggtgatacaggtttggtcaccaaatctttcgttctaaagtttctttaaataggagaaagaatgcaggaattttaattatcaacaaacattttagagttcattaaatcatcaaaaaatggttttcaagtcaaatcttttgcttatcaaattttctttgcttgtgcttctgatggttttctcagaggttgctgctagggatatgcctgctctgccttcacacccattactcaaatgttagttttttatcttatttttgcttccttttatattctcttggtaatttttttgggtgaaaagggttaaaagtagtagttgtttactgtatgaaatatctttatcaactgatatagtatatactttgaggtcattcgtgcgcttgctataagaaaatcatcgagctctctaaattaaaatataacgaataataatattaaatcataatataaaaaataaagaggtaaatttcaatgtttccttgagccgagggctatcgaaaacagtctatctgtctatctacacatgataggggtaaggggttgcacgcactatcctcctggccaagccgtacttatgggattacactgtgtttgattttgttattattgaaggctagaggtcccatagaaaaaatatgagacaatttgctaatgataacgaatgaatgacctcaaagtataacatatgataaaattaagatattttactgtaactaagtaattggactttttcccagtctgtagaaaacgaaacaaagagaaagaaggccctctatttgcctgcatctttcatttattattattattattattattgttattattattattattattattattattattattattaatattattatatacttgaatttgggtgcagcaaatgaagctcaggacacaactgggacgttgaatcacccaattaagccacaattgtggaccttgaatcccacgatagggccttataatgatcttgttgtttcatattgtttagagtgcaattgttgtaatccctgatgaaaactgaaggatcatattcctccttagtatactacatatatactttgtcaaataacatgagattagatcaagaaccatcactttctacttttctcataatatatactacgagtttttagaaaaattatatttaaaaaaaaacagaagttgcaatgtctaccactcgtatggtacagaggttgatccagaatttaaattttatgggtttaattttaatgttcttagtaattaaactcattatatcctaaattaaagttatgggttcatatctataatttattgcgattttaatggtttttgtaaataaattcgtgctttgagttgaaagttatgggttgaacccggtgttgtagagctacatccgcccctatatgtgtaaatatattgaggtaaatttcacaaatagtcatataactatatgattttttgtcaccaaagttatataactttatgttttctcacacaaaaatcataaaactttcaataactcacataaaaatcatagtgaccgaaaaacacaattttacgatagtattttcttattccatattttttattttcagtctaataaataataatctaattaaaataggagaacttagccgctttaaaaaataatagatgataaactatatatttttatacatatgtaatttacatattttatatatcttttgtctagcgaatgcatttagtttcgaccgactggtcatttttgaattattttccttaaaataagaatgactcgacccgaccgaatacccatatacatatattaaaataatactaaaaataaattctcttcccacaaaattttttagtttgaaatgcatgagattctgaccaaaaaaaaaaaaggtataattagagagtatttaaaataaaaatgctataaatttgaacgaaaatcttgaaaagaaaaataaaagatagaagtatcgtattttgaaggattcatttttagtattattttaattttcatatatgggtattaggtcgggtaggtcaggtcgagttggctcattcctattttaattggattattatttattagatagaaaatacaaaatcgtggaataagaaaatgatactgaaaagctgcatttttcggtttgtcacgacccaaatcccaccatagtccgtaatagcacccaatgcttccgctaggcaagccaacgatgcaatcaacacgctaatagataatctagaatgcatctcgaaataaatagctaaaattgttcgtgtttatcgaagtgttattatattattttaaatgttcgaacgtggtaaaatcataaaccagaatatcatgccagtgtacaaccaataacaaaatccaaatccccaaaacctgatgtcacaggtacatgagcttctattagaatatatactactactacaacgactgtcttgataggaaaatagatagaatacaataaatggatatgacgaggattttgtgtgctgcggatcgtaacatagagaacaactcaccgtaaaatttcctcaacaattgtgcctacgcgcctagatgatcaccaaatgtacctgtctcagtacctacacaattagtgcagaagtgtagtttgcgtatgtaattcaaagcgtaaccagtaagtatttagcctaaccccaaataagtagtgacgagaagtcgacatcaacacatactaacggtccaataaatcaagtacgataaaagtagacaggtatgaagcatgacaaataaaatagtaaaatcagataaattatccgacccgatccatatttaatacggataaataatggattaaccggtggataatatatgtaaccatattatccatgatttattgcatatgatcaattttgagagaattcttagtcttttgtcacgactcggatttctcaccctcgggaatcgtgatggcgcctattattaggaactaggcaagccgactattaattacctcatttagcaaacatcaaccatttaatagaaatgaagcataatacgataatgcggaaatttcaaatataattaactgaaataaatgtggaagtttaacaacatcctctacccaagattggtgtcacaatactcattaacgtctagagaatgctaaatacaaggtttgaatgaaatataaaactgtctgtttcggtacaagagataacaaactgaataaagatagaagggactctggtcctacggacgtcagcaaggctacctcgatgtctctggactgaaggtctgctcccaaatctactgttgctgtccaaaagcagctccagcaccgtgatctttgcaaaaagatgcacagagtgtagaatcagcacaaccgactccatgtgctggtatgtgcctggcctaaccccgacgaagtagtgacgaggctagaccggaatgccaaacaaacatgtgcatatatatatatatatatatatatatatatatatatatatatatatatatatatatatatatatatatatatatatatatatatatatatacatgcaatagaaaggaacacagaaaattaaccagtcaagagggaggggaacatgctgtagggctgtaacatttcatatgtgaacccaataaataaggaatgaagctgtataactacaatatcatcgagaataagaaatcaacagttgcacgatatcatccttcgtgcttttactctcgttctcaccaaaacaatcatataaagtacacggcataacccttcgtgttttaactcacataatagtgacacagaatgatccttcgtgcagtaacactcatatcatagcacggaatgatccttcgtacattagtaatcatatcatggcacggaatgtttcttcgtgcattaacatattctcaacacaaaccgtgcatgacatcattcttcgtgctttatcactcttcctcacccaagcaacaatcacaactaatggggataggggatagaaaaataataatagatatcccggcaagggaaaacacaagtaaacagttaaatcccggcaaaggaacaacaacaacaactttcacatcccggcaagagagataatcaatatacgaaaatagcccgtcaagggaataagcacatctatttatcttctttttatttcttactctataatttactttatcattcgagccaacgctccaaagagtttacaattcataatttcattttcatactctttcactacatagaaatcagcaattaaacatggaagagtcacaataaaataagaataaacataatataaggactcacagtcatgctagacaccagtgtatagatactcgtcaccatgcatatacaccgtactcgataattagcaattagcaaataagactctactcctattccctcaagtcaaagttagaccaaacacttaccccaacttccacggctaagtcaatccataacgactgctttccctatcgaattcggctccaactcaatcaaatctatgaaataacgactttataatatcaataatagctaaacaaatcaaatccaatgcctaaatacagatttccaacctttctttcaaaaatttcaaaaatcgaccccggacccgcttggtcaaaacacgaggttcgaaccaaattcatatcaccaattcccccacgatcccgaatatataattttttttttcaaattcgaccccaaaaccaggtctaaatcaaagaaaattgaaaagccctaactctacccaattccctcaatttcaaccctagattacatgatttgagcctaggaatttgataaatgatgaaggaaaatgaagaaaacaagttaaaaaatgcttacccaagaagccttggtaaagaagagctctagaaatcgaatatgggttgtggagaagaagagtccgtgtgtttttgggtaaaaaatcccgtcactgttctgttttggacatttaaaattattgggcaaaatttcccttcgcgttcgcgaagggtaagtgggacagggcatcgcgaacgcgggaggataatcacgaacgcgtagaaggaaggactggggttctgggatttactctatgtgaacgcgtgaagggtcacacaaacgcgatgaagaagtctgcaaggttacgcattcacgaaaagttgaatgcgaacacgtagaaggaaattgttgaggtactgatttggcatacgcgatcacgataattgagaagcgaatgcgaagaagaggggactcaaagctatgcgaacgcaagaggactagtgcgagtgcgaagaagaagatcactgtgtaaaattacagatttttggcaatctccctaagtccaaaaccaccccgaacacctccgaaaacactctcatgccctccgggctcctaaccaaacacacacactaactcgacaacatcctacgaacttaaccgtgtgatcaaatcgccaaaataacaccataaatgaggaatcaaacctaaaaatcatcactttttcatcaaacttcatcaacttccatttttagagatttaggtccaaaacacgccaaatgacgtccgattttaaccaaatttcatagaaacgtcttaaatcacatataagacctgtactgggagtcggaaccaaaatacggtccagataccaacgcgttctaatccattttcatttcaaatttccatattaatttcagaaaaataatttcttttaaaaattcatttctcgggctcgggacctcggatttcgattccgggcatacgcccgagtcctatatttttctacgaaccctccgggaccatcaaatcatgggtccgggtccgtttacccaaaaagttgaccaaagtcaactttaatcattttagtatccaatcttagcattttttttatagaatttcatatataagctttcctgctacgcgcctggattgctcacgcaaatcgtggaaactaaaagtgaggttttcaaggcctcagaagcacgtaaagagagagaaatcaggtgatgaccctttgggtcgtcacattctccatctctaaaacaaccattcgtcctcgaacggacaaaagaaataagtacctgagtcggaaaatagatgaggataacggctccgcatatcagactcggactcccaggttgatgcctcaagaggctgacctctccactgaacacgcactgaaggaaaactcttcgaccttaactgtcgaacttgccggtttagaatagctcctcataagacagatccttgtccaactggacactgctgaaatctaacatgtgggatggatcgccgtgatacttccggagcatagacacatgaaacactggatgcacgactgacaagctaggtggcaaggcaagtatataagccaccttttgccacacgatcaagaatctcaaatggaccaatgaacctagggctaagcttgcctttcttcccgaatctcatcacgcccttcataggcgacacactgagcaatactcactcatcgaccataaaagcaacatctcaaaccttgcggtctgcataactcttctgcctggactaagctatacgaagcatatcctaaataatccagaccttatccaaggcctcctgaaccagatccatacccaataaccgagcctctcctggctcaaaccatccaactggagaccgacatcgcctaccatacaacgcctcatatggagccatctgaatgctggactggtagctgttgttgtaggtaatctctactaacgtcaaaaactgatcctacgagcctccaaaatcaataacacaggctcggagcatatcctctaaaatctgaagtcctctgaaactgaccatccgtctcgggatggaatgctgtactcaactcaacctgggtgtccaactctcgctgaacctctttccagaagtgtgaggtaaactacgtaccccggtccgaaataatagataccggcaccccatgaaggcgaacaatctccctaatgtagatctcagctaacctctcggatgaataggtggctgcaactggaaaaaaatgcgctgacttggtcaacctatcaacaatgacccaaactgcatcaaacttcttccgagtcatcggaagtccagtaacgaaatccatggtaatcctctcccacttccactcgggaagctcaatcctctaaaataatccaccaggccactgatgctcatacttaacctgctgacagttcaaacatcgagccacatatgcaactatatccttcttcatcctacgccaccaatagtgctgccttagatcctgatacatcttcgcgccgcccgggtgaatagaataccgagaactatgggcctccgctaagatcaactctcgaatcccatcaaaattgggcacacaaacacgtccctgcaatatcaaaacatcatcatcatcatctaaagtcaccttcttggcacctccacgctgcaccgtgtctctcaggacacacaaatgggggtcatcaaactgccgatcacggatacgatccaataatgaagaacgagcaaccgtgcaagctaacactctgctaggctcaaaaatatccaacctcacaagtcgattggccaaggcatgaacatccaaatcaagcgatctctggctaaccggaatataagcaagactacccatgctggcggacttcctactcaatgcatcggccaccacattggcctttcccgggtgatacaagatagtaacatcataatctttcaacaactccaaccaccttctctgcctcaaattcaactccttctgcttgaacagatattgaagactcttgtgatcagtgtacacctcacacgtcacaccatatagataacacctccaaatcttcaaagcatgaatgatggctgccaactcaagatcatgaaccagataattcttcttgtagatcttcaactgcctcaaagcataggcaatgactctgtcgtcctgcatcaatactgcaccaagaccaatacaagaagcatcacaatagactgtataaggccctgaacctatgagaaaaaccaatactggtgccgtagttagagctgtcttgggcttctaaaagctcacctcacactcgtctgaccatctgaaatgggcacccttctgggtcaacctggtcattggggctgcagtagacgagaacccctccacaaattgatgatagtagcctgctaaccccaagaaactccaaatctctatagctgaagctggtcgaagtcagttcttaactgcctcaatcttcttctggtccacctgaataccctctactgatacaacgtgacccagaaatgcaactgaactcaaccagaactcacacttcgagaacttagcatataattgactatccttcagagtctgaagaactactctggggtgctgctcgtgctcctcctggctgctggagtatatcagaatatcatcaataaagactatcacgaacaagttcaaataaggcctgaacactcggttcatcaactccataaacgttgttggggcatttgtcaacctaaatgacatgaccaaaaactcataatgcccataccgagtgcggaatattgtgttagggacatcggatgccccaatcctcaactgatggtagccagatctcaagtctatctttgaaaacacctttgcaccctgaatctggtcgaaaaaattgtcaatcctcggcaatggatacttgttctttatcgtcactttgttcaattgtcggtaatcaatgcacatcttcatcgaaccatcctttttattcacaaataacaccggcgcaccccaaggcaaaatgctgggtctaatgaaacctttctcaagtagatcctgcagttgatcctctaactcttttagctctggcggggccatgcgatacggcggaatagaaatgggctgagttcccggagccagatcaatacaaaaatcgatatccctgttggacggcatacccggtaggtctgaagggaaaacctcagggaactcccaaacaataggaacagaatcaatagaagggacctgtgcgctggaatcatgaacatacgacagataagctaaacaccccttctcgaccatgcgtcgagccttctcatataaaataacactgcgggtggtatgatctggggtccctctgcactctagttggggcaaatctggtaaagctaaggtcacggtcttggcatggaaatcgaagatagtatgatacggggacaaccaatccatccctaatataacatcgaaatccaccatatctaagagcaataaatcaacacgggtctcaagacccctaaacaccacaacacagaaacgatgaactcggtagaccactatagaatcacccaccggtgtagatacataaacaggaatacttaaagcatcactaggcatggccaagtacggtgcaaaataggacaacacataccaatgcgtagacccagggtcaaatagcactgaagcatctctatcacagaccagaatagtacctgtaatgacagcatttgatgactcagcctttggcctggctgaaaaggcataacaccggggatggtcagctactggctggcctctacctctggcggtctgagctccacctctatgacctatacctccacctctatgacctctactcccacctctagctggatgggtaggctgtggaacacctggtgccttaatcataggacgaggaccctgctgctgggaactacccgaagctcgagggcaaaatctaataatgtgactcgggtcaccacaagcgtaacaagccctcggttgctgaccctgtcaacctgaacgtcctccccgaaaactctggaagggtggtgcactgttgggagcaggtcgtgcactaaaaaactgttgatcaaaataatgcgactgagaaccactatcacctgaaataccatgagagacttggagagcagactaaaagggcctcgggggatagcctctaccataagaatctctacctccagacgaggtaccactgagcctacctgcttgacggggccttttatctgacccatgaccacctccctgtgcaagagccatctctatcatgcgggccgcattagccgcctcctgaaaagaattctcactcccgtttcccatagccatctagagacggactgaatcaaaccatcaatacacctatgaaccctctctctctcagtggggagtataacaatagcatggcgaactagatcaatgaaccgggtctcatactgagtgactgtcatagagccctgctggaggcgctcgaactgcttgtgaagagcctccctctaagtggctgggagaaacttctccaagaataactctacaatctggtcccaagtcagagatggcgaccctgctggtctggctaaacaatagtctctccaccaagtcttggcggatccagatagacaaaaggtggcaaagtcaaccccattggtctccacaataccaatagtccgaagaacctcatagcagctaaataagaaatcatgtggatcctctgaagaagtaccattgtatgtagtagtgaagagcttggtgaatcgatccactctccacagagaatcagcggacatcttcgcaccatcgccggtctgagccacaatacccggctgaactgccacagctggctgaaccactggaacttgagcctgaggagctacctgcttcggagtacgcgtagcaagagtctgaactcctcctccatcctgagaagtggctggttctactagaagcaaacccgctcgagtaacgctctccataaggcctacaaatctaaccaaatcatcctgaagaactgggtggctatgaacccttctgggacctgagctgggcccaccggagctgctggagctggaacctcctcgtcataatcaatatgaggctccacctctaggactgctgctcggggctgagctctgcccctgcctcggcctcaccctctgcccctaataggagccgatgttgggggctcgggcagctgcgcagtagaagaggaagcacatgttctcgccatctgcgaaagaacacagtagaaagacaatgagtatttgagaaacagaatcgcacgacaagaaagaacaaagtaaaatattcctaactttgtagcctgtggggataaatacagacgtctccgtactgatccctcaggctctaccgagtttgtccgtgagttgtgagacctatgcaacctagttctctcataccaacttgtcaagacccggatttctcaccctcgggggatcgtgatggcgcctattattaggaactagtcaagccgactattagttacctcatttagcaaatatcaatcatttaatagaaacgaaacataatatgataaagcggaaatctcaaatatagttaactgaaagaaatgcgaaagtttaacaaaatcctctacccaagattagtgtcacaatactcacgaacatctagagaatgctaaatacaaggtttgaaaacataaaactgtctgtttcggtacaagagataacaaactgaataaagatagaagggactccggtcctgcggacgtcagcaaggctacctcgatatccctggactgaaggtcagctcccaaatctactgatgctatccaaaagctgctctggcaccgtgatcagtgcaaaaagatgcacagagtgtagcattagcacaatcgaccccatgtgctggtaagtgcctggcctaaccccggtgaagtagtgacgaggctagaccagactaccaaacaaacctgtgcagttcaatatatatatatatatatatagaaaggaacacagaaaattaacctgtcaagagggaggggaacatgttgtagagttgtaacagttcggatatgaatccaataaataaggaatgaagctgtacaactacaatatcatcgagaataggaaatcaaaagttgcacgacatcatccttcgtgattttattctcgttcccaccaaaacaatcatataaagtacatgacatcacctttcgtgctttaccttacataataatggcacggaatgatccttcgtgcagtaacactcatatcatggcatgaaatgatcctccgtgcattagtaatcatataatggcacggaatgttccttcgtgcattaacatattctcaacacaaaccgtgcacgacatcaattttcgtgctttatcactcttcctcacccaagcaacaatcacaactaatggggcgagggaatagacaaacaataatagaaataccggcaagggaaaacgcaagtaaacagtcaaatattttatagctaattaatgttaaaaggtgaatttcttaatacgtgtgaaagcaatcaaaaaaccacttattttggaccggagggagtatatattttagatacatattctccattattcaaagtaaaatacaaatactgaaaacacctttgatctctaacgtaataaaattaaactagaaccaaaccatatggatattcttattattaattaataagtactttaagtaaaaaaaagtactcaactagctatcaatagaactccactacatatataattgttccacacatttcaactttattaatattgtattagatttattaaaattttaaataattgaatatgaacatcattgtagagttcaatattaaataattttaatatcttttataacataagcaaattgaataagaaagctttgggaaatttcaataatgaaatatgggcgaaaagaaatggaaaaagaaaaaaacgtactgaaatattgtcatgacccgaaattttcaccattgggagtcgtgatggcgcctactcgtggaagctagaaaagccataaacctttgcaaatcattaatcctttttcattttatacttgtttaaataattaaattaataatggataagcaattaaatgacagcgtaaaataaacttttagcggaagtcttagataaatataaaattaaaatacgcaatagccaatacatgtcaccagcacctggtgtcacaacgtacacggactatctaagagtttaaatacaagagtctgaacaacgaaataaaactctatctcgggtacaaaagaaacagtgcataaatagatagaagagatgccgggcctgtggacgcctgcaggattacctcgggatctcgtggactgaaggatggctccctagctattgttgtgcacggtaagctgctccggtatctgcacataagtgcagagtgtagcattagcacaaccgatcccatgtgctggtagtgtatagcctaaccctatcaaggtagtgacgaggctaggaccagactaccaaataaacctgtgcagttcaaatatatatatatatacagcaaaaaagaaatacaggaaataaccagtcgaggtgagagggggaaacatgttgtggggaaggtaacagttccgaatagacaacatcaagtaaggaacgaaacaacataactaaagtatcaacaagagtcagaaatcaacaatttgcacgacatcacccttcgtgtttttactctcgtcctcaccaaaataatattttatgataaaagtgtgcacgacaccatcctttgtgattttactctctttcctcaccatataatcaataaaaatcggtacaaaatggtccatcgaatggcacagcatcacccttcatgctttacactctttattcacaatagaaattaatgcacgacatcacccttcgtgctttaacatgcttcctcacccaaacaataaccacaaacaaaggggcaagggaataagcaaattagtaatagaaatcacggcaagggaacaacaattaaacaattaaatcccggcaagggaacaacatcaataatctcaacatcccggcaaagggacataatcaacaaagcaacaatgtcccggcaagggaaacaatttaataactctttctctttctttcacttttatttcataactcactttaccacttgagccaatgctccaaagggttcaatcatcttatatactttcacaattcgtattataacttgatccaatcctcctcgatgttcaaaggtcacaatttcttcctcaaacttttcacaacatttagaaataattactaaggcatgaaagatacaacaaaatcaagatattcacaatttaaagactcgcggtcatgttagtcactaacgtatagatactcgttaccatgcctatacgtcgtactcaataatcatcacatagcaaataggactcaagtcctaatccctcaagctaaggctagaccagacacttacctcaaacttccacgcccaattcaatcctcaattactgcttttcctctcgaattcggctccaaatcgattgtatttatacataaatgactttataacatcaatatatgctaaacaaatcgaatccaatgcctaattatagcttttcaaccattcttcccaaaattttaaaaattgactccgggcccgcttggtcaaaacaagaggttcgaaccaaaatcaaatcacccaagaaaggcaagggaacaacaacaacaactttcacatcacagcaagagagataatcaatatacgaaaatagcccggcaagggaataatcacatctctttttcttcctttcatttcttactgagtggaactttttgggcgaaggcacgtagcctgagtcgttcttcaactgtggttgaattttgcaattcttgatggcgaaggcacatggcctgagtcctggttcaacttgtagttgaactattcccagttcaactcatagttgagctttttgggcgaaggcatgtagcctgagtcgttcttcaactgtgggatctataatttactttatcacttgagccaacgctccaaagagtttacaattcataatttccttctcatactctttcacggtcatgctagacaccagtgtatagatactcgtcaccatgcctatacaccgtactcgacaattagcaattagcaaacaagactctactcctatttcctcaagccaaagttagaccaaacatttacctcaacttccacaacgaccacttttcctctcgaattcggctccaactcaatcaaatctatgaaataacgactttataatatcaataatagctaaacaaatcaaacccaatgcctaaatatagattcccaacctttcttcaaaaaattccaaaaatcaaccccgggcctgcttggtcaaaacacgaggttcgaactgaattcatattacccattcacccatgagctcgaatatacaatttgttttcaaattcgaccccaaaatgaggtctaaatcgaagaaaattgaaaaaccctaaatctacccaatttcaacgctagattacatgatttgagcctaggaatttgataaatgatgaagaaaaatgaaggaaataagttaaacaatacttacccaagaaactttggtgaagaagagctctagaaatcacctaggggctgtggagaagaagagtccgtgtgtttttgggtgaaaaattccgtcactgttctgttttggacatttaaaatcactgggcgaaattgcccttcgcgttcgcgggaagggggacgcgttcgtgaagggtaattgggatagggcatcacgaacgcgggaggaaaatcgcgaacgcgtagaagaaaggactggggttctgggatgtactctacgcgaacacgtgaagggttacacgaaagcgatgaagaagtctgcaaggttacgcgttcgcgaatagttgaatgcgaacgcgtagaaggaaattgttggggccctgatttggcttacgcgattgcgatgaatgagacgcgaatgcgaagaagaggggactcaaagctatgcgaacgcgagaagactagtgcgaacgcgaagaaagggatcactgtgtaaaaattgcaaattttctgcaatctccctaagtccaaaaccaccccgaacacctccgaaaatactcccgagccctcggggctcctaaccaaacacacactaactcgacaatatcctacgaacttaaccgtgcgatcaaatcgccaaaataacatcataaacgaggaatcaaacctcaaaatcatcactttttcatcaaacttcatcaacttctattttttagagatttaggtccgaaacacgtcaaatgacgtccgatttcaactaaattttacagaaacgtcttaaatcacatataagacctgtaccaggtgccggaaccaaaatacgggccatataccaacgcgttctaatccatgttcatttcaaattttcatattaatttcagaaaaagaatttcttttaaaaatttatttctcgggatggggaccttggatttcgatttcgggcatacacccgagtccgatatttatctacggaccttccgggactatcaaatcacgggtccgggtacatttacccaaagtcaactttaatcattttaatatccaattttagcatttttataaagtttcatataaagctttccggctacgcgctcggactgtgcacgcaaatcaaagcaactaaaagtgaggtttttaaggtctcggaagcaagaaaagagagagaaaacaggtgatgaccctttgggtcgtcacatctctctaacttaagaaacccccaatttgaggctttacagatgtaaaagttagacccattggttatccatttttcaaatggataatatggttcttatccatatctgacccgtttttaaaaagttcattatccaacctatttttaatagataatatgggtaattaactatttttttaaccatattgccacctgtgatgacccaaagggtcatcacctgtttttcccctttttctgtgcttacaagaccttaaaaacctcatttttagtttgccttgatttgtgtgcgcagttcgggcgcgtagccggaaagcttatatgttaaattctgtaaaaatttggtgaaatttggtattaaaataatttaagttgactttggtcaatatttttggtaaacggacccagacccgtgatttggtggtcccggaaggtccatagaaaaatatggaactcagacgtatgcccggaattaaaatccgaggtcccgagcccgagaaataaatttttaaaagaaattatttttccgaaattaatataaaaatttgaattgaaaatggattagaaggtattggtagcgggcctgtattttggtttcggcgttcggtacaggtcttatatgtgatttaagacgtttctgtgaaatttggttgaaatcaaacgtcatttgacgtgtttcatacctaaatctctaaaaatgttagtttatgaagtttgatgaaaagtgatgattttgaggattgattcctcgtttttatgttaatttggcgatttgatcgcacggttgagttcgtaggatgttgttgagttagtgtgtgtgtttggttaggagccccgagggaacgggagtgttttcggaggtgttcgggttggttttggacttaggaagattgcagaaaatctacaatctttgcacatgcattcccttcttcgcgtttgcggccttcagcttgcgttcgcaatgcttctcaggttcccttcttcgcgttcgcgtctcaaccctcgcgatcgcataagccaaattcaagaccctagtaattccctcttcgcgttcgcgttcgcattccacagttcgcgaacgcgtaactttaccattttcctcattgcgttcgcgtggctcttcacgtgttcgcgtataacaaattcctggaccccccagcttttccctccgcgttcgcattcccccaatcgcgaatgcgatgcactgcccagtttcccatcatgaacgtgatatctctcccgcgaacgcgtagggcaaattcgcccagttatatttttaagttcagtgaaacagtagttacgggtctaactcaaattctcacgaactctcttcatccccaactcttaggagtccattgaagcccccattcttcaagaccacttgggtaagtaaattcccacttatttccttcacttttctttattaattattgatttctaagcttaaatgacatagattagggtgaaaattggggaaaatgggtagagttagggcttttcaatcttcttcgatttagacctcgttttggggtcgaatttgaaaataaattgtatattcgggctcgagggggaatgggtgatatgaaattggttcgaacctcgtattttgaccaagcgagcccgaggtcaatttttaaaattttgggaagaaagcttagaaatctatatttaggcattgggtttgatttttttagcttatattgatactattaagtcattatttcatagatttgattgagttggagccgaattcgagagggaaggcgatcgttgtggattgattttagacgtggaagttgaggtaagtgtttggtctaactttagcttgatggaataggagtagagtcttgtttgctaattgctaatggtcgagtgcggtgtataggcatggtgacgagtatctgtacactggtgtctaacatgaccatgagtccctatattgtgtttgttcgattttcattgtgattcttccatacttaattgattctttggagcgatgactcgcatgataaagagaattataaagtggaaagtgaaagaaaaagaaatagatattggttattcccttaccgggacgttttatcagttttgctgattttctcccttgccagtatattgagttcattgatatttctccctcgccgggacttagttgtgttattgtattcccttaccgggatttctctcattaaattgttactccctaccctttatttgcgactgttgtctgggtaaggaatagggatattatatataaggatcgggttgtgcgccgcaacaaatatataagatatctatatggatcgggttgtactccgtaacaacactaaatgatatggatcgggttgtacgccgcaacaatgataactgtggatcgggttgcacgccacaacagtattgttatatgattggatcgggttgcgcacctcaacaaattatagattaagtgtgcttattccggatataagtttctgttgactgttctatctttaaatttagacttcatgtttgtaactgctgcctcccacatcatgccccccctccttttataaactgcttatatcctgtttattttttcgcaatatatatcataactacataggtttatctggtagtctggtctagcctcgtcactacttcgccggggttaggctaggcacttaccagcacatgggttcggttgtgctgatattacactctcttcatctttttgcacagatcacggtgccaaaacagcttttggacagcagtagtagaccgggagctgaccttcagtccagagaccccgaggtagccttgctgacttccgcaggcccggagtctcttctatccttactttagtttgttatcctttgtaccgaaacaaacagaattatattttattcagatattgtatttagtattctctagacgtttgtgagtttgtgactccagttcttgggtagagtttgtattggatttccgcatttcttttagctatttaaatttaagacttccgctttattattaatatttcatttttttaaatatattgtcgatgtttgctaaaagatgtaataggtaattggcttacctagctcctatagtaggcgacattacagctcccgagggtgggaaatctgcgtcgtgacaccacccatatttatgattaaccgttagccaaatgataacattattcgaagtaaaggtatagtatcattcgaagtacaacaactactaagcttcagtttgaaacaagttagcatattcgactgtagcttgtatgaatcttcactactaaaaatagcgcatcctacattataggaaataaaaataaaataaaagagaacaagttaaaaaatcaccagctaaatatgggataattcaatgatattgctggggagtcgtttggagtttttcattaattttattattagtaatattttggtcaggttttctcaggtcactgttcgagtcgtagaatgagccatttatgcttgcattaacgaaggctttttacatcatacctattggggcgcaactcttcttcaaatcctgcacgaacatgaaaaactttatacactaaattgctctttttataaatgtgtgttgttgaggtcattgaataccaacaacacaccaaaaaaaacccaaatgaaatcttacaggtggggtgtggggagagtagtatgtttgcagatcttactcgtatcttatgaaggtagagaggtcgtttccgaaagactctcgactcaagaacattaaaaatgaagcgatagagaaacaatagcaacaacaaggtaataagacaatggaagtaaataatacaacgagtaataacagagatccataaatacgaaaatacaagaatagtgtcaatcttactgataataatgatacaccgtataaaaacaagggactaggactaagaaaatacccgactagtactgctactactggtaagacaaggcgaaactctaaattgtctatcaacccaccaacctaattctcgacttcaacatctttctatcgaaggtcaatgtataaaaaaaacagttattaacagaacttaaaaacaacaagcatcccacaacatttatttttcccaaaataggttatcttaaagttgcctaaacgagcacatatataggtgatataggtttggtcaccaaatctttcgttctaaagtttctataaataggagaaagaatgcaggaattttaattatcaacaaacattttagagttcattaattcatcaaaaaatggttttcaagtcaaatcttgtgcttatcaaattttctttgcttgtgtttctgatggttttctcggaggttgctgctagggatatgcctcctcagccttcacgcccattactcaaatgttagtagtttttatcttatttttgctttatattctcttggtaaatttttttgggtaaaaagtagtactactatgaggtcattcgtatcgttgcaataagaaaatcatcgagctctaacttaaggtataacgaataataattttatatttataacaattaaatattaatacatatttcgtgaatatgttatataaatacaaggtttaagcaaaagttactggattcgtccgaacctgcatttacttctctagctctacaactgttcacaagatttggttatataaggtctacatacacactattctccccaagccgcacttgtgagactacactggatttgttgttgttattaaatgctggaggccacctaaaaaaatatgagacaatttgctaatgataacgtatatgaataagctcaaaatataacatatgataaaattaagatatttttatggctattatattatctaagagaaatactattgtacttgaatttgggtgcagcaaatgaagctcagagtacaactggaacgttgaatgacccaattaagccccaatggtggaatctcgcgaaatcgatagcagaaatggctgcttcttattgcatagagtgcaattgttgtattcctggaaaaaactgaagaatcatattcctccttactccttagtatactaaaaatatatactttgtcaaataacatgagataagatcaatgtatgaacattacgttccactcttctcataataaatagtacgagttgttagaaaaattggaggaaaaataaaacagaagttgcagtgtttaccactcagtatgtgtagatatattggggtaaattttataaatggtcatatacctatgatgttttttccatcaaaatataactttgttttttcatacaaaaatcataaaactttcactaactcacgtaaaaatcatagtgaccgaaaaacacaattttacggtagtattttctttttccacattttttttatttttattttttatttttcagtataatgaataataatctaattaaaataggagaaatatttatttttagccgcttaaaaaattaatatttgataaaaatatatttatatacatattctatatatttttttatctagtgaatgcatttagtttcgatcgactggtcaattttgtatttttcttttaaaataggaatgacccaatccaacccgactcaacccaatacccatatgcatatattaaaataatactaaaaataaatcctccccctccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccccccccccccccccccccccaaaaaaaaaaaaacttgtttggaatacatataacaaaaaaataaaaggtataattaaaagcatttgaaataaaaatactataaatttgaatgaaaatcttgaaaataaaaataaaaaaaagtatcgtattttgaaggattcattttttgtattattttaatttatatatatgggtattaggtcgggtggttcaggtaggatcggctaattcctattttaattggattattatttattagacagaaaataaaaatcgtgaaataagaaaataatacttaaaatttgtattttcggtctgtcacgaaccaattcccatcatagtttgtgatggcaccaaacgcttctgttaggcaatccaacgatgcaatcaacacgctaatagataatcaagaatgcatctcgaaataaatagataaatagtttggttttatcgaaaagtattagtgttattattttaaatgtttgaacgtagtaaaattgtaaaccagaatatcatgacagtatacaaccaaaaacaaaatctaaatgttataccccatgtctttgtacgtgaaagtacaccataagtaaattgatggaagctcgaaaaatgagatgttacatcccccattttcgtacgttaaagtttcgtcgtaagttaatcgacgtaagttcgagaatgagattattttgagattataagcattatgcaatttcaaacaagtgatgagaaaattcgtgaatgtgagagggtaagcaaatcgaagaaaacgaatttcatcaaagtttgacattttaggataaaatacggtccgagctataatactgctgttatggactagtgccatacaaggtactacatgaccatgatagtaaggtgtataaggtatgttcaaaatgagtagtagtttaagtaatttgggataattcttaattatgtggataattgagtaattatgaattgttaagtgagagattaacttataattaagaaattattggataaggatttaatccttacacatggcacccaacaaaatgtgactcttaaagctcacatataattggcatgtttagaataatagttggccaagtcatccataactatggggcccacatccatacgtaagatatctcaaattcatatattaccaacataaataattgtaacgacccgaccggtcgtttttagaatttgcaccccgttcccccgttaactgcttcccctaagtttatttaagctattctgatttgctgggatgttcggtatttgaattcggagtgtttttggacaaatagtccttaattgagagtctaagtgttggaaagtggtccgttgtcggaacagtgtcaagacgacctcggaatggaaattcgatggtttcattagctccgttaggtgatttcggggttgggagcgtgtccggatcttattttggatgtccgtagctcaattagcctagaaatgccgaaggttggaaatttggaatatccggtccgatagtgaatttttgatccgaggatcggaacggagttccggaagttcctgtagcaccgtcatgtcatttggaacgtgcgtgcaaaatttcagattaatcggacgagttatggataggtttttgatcgaaaatgatttttgttaagttttggaaaatttaagttgaaatcaatgagtaattcgtgtttccggcgttgttttaggtggtttaaggattggtacaagtccaaatgatgttatggattatgatcgtaggtttggttgaggtcccgggggcctcgggtgtgtttcggatgctcaacggagcaattccggactcaaagtggttgctgaaactgctggtgtaatgttgcagagaattccttctatgcgatcgcataggtgctacgcgatcgcatagagtcccatgatctggcccagattttccttcaatgcgatcgcatacttcactctgcgatcgcatagctttgtctctcccttcagtgcgatcacattccttgtccgcgttcgcatagagcatttagggcctgggccttgaggccatttttcttatacgcgatcgcataccctcattgcgttcgcataagccaattttgggctgccacctttttactctatgcgatcgcatcagtccttccgcgatcgcatagcacaaacccctgggcagtattaaaacatttcaaaacgaacctccttccatttttatcaaaactcaagtttgggagctcggtttggggagcaatttcaaaggcttttcaaaggaaatcactgggtaacgattctcttcccttctatgactaaaacctactaatctaaacttgaatccaagctctaatttcggattttgtaagaaaattggggttaagttcttagacctaactttgatgatttgagggaccatttgacctccgatttgggtgaattttatatgggtagactcgtgagagtgcgaggtttctaaaaatataaaaatattctgattccgagacgttggcctgaggggcattttggtcattttacctattttcgcgccgtagcttcaattttattagtgtaattagttaattgcgtagttatttatacattgtaactggtttgaatagattcgggccattcggagttggatactcgtggcaagggctttgcttcatattgatttggtaccggttcgaggtaagtggcttgtctaaccttgtgtgggggacttctccccttaggatatcctatttgctattttaaatgccttgtgcgcgaggtgacgggcgtgtacttgagctaaatgttgaaatttcactttacttgggatacttagtctgtacctattcgattattaaactgttagatgctagctacctgtgttaatgtaggaaaaacatgttagttgatttaactgccctatttgacttagttgaaatacttgtttttccgtgaagcatgcctacttttagattttgcctgttgcctcacttagtaatttccttgggttgtactactgcgatgtaattatgagttttcctgaactttggatattctgagactggccgtgcggataccaagagatccctggcatgtgattgactataattgaggataccaagagatcctcgggatactaagagatccctgttgcttattggaggatactaggagatcctcgggatactaagagatccctgttgcttattggagaatactaggagatcctcgggatactgggagatccctgggatactgggagatcccttgtgaatatttgaggataccgggagatcctcgggataccatgagatccccggtgactgttagcttgttattaatcgtttcgttcataggttgtattattcgaattgtttcattactcattatcctgttagtcatttaaactgctgtatttatctccgtgttatattattgcttcatttatattatctcagtatggcctcgaccttcctcgtcactacccaaacgaggttaggcttggcacttactgagtaccgctgtggtgtactcatgctactcttctgcacacttttgttgtgcagatccaggtacttccggcacggcgtttcggcagtgagtccggtgcagctactcaggggacctgaggtatacatctgccgcgtccgcagatcctccgagttctccttctactctacccgtatttagatagtagttatttctattctctcttgtattagacttcagaatgtttagagctggatacgttcaggatcttagcctgtgttgcccgtgagtttccgggttttggggatgatttcaggagaattttacatgctaagtgtatgtgccgagcggcatttattacatttactatattatctctgcttttactgtcttctcttatgaaattgttataatccgcaatgagttaggcttacttggcctcaccagccaggtgccatcatgacatgttcacagtcggtgaactagggtcgtgacaataacattagccattctagtatgaatctgcacatgtaagatatctcaaattcataaataatcaacataagtgacgttagccatgaatctgcatatatcacataagcacgcaagatctttaacaattcaaagcaacgtaaggttgcgtaatcataaggaagtaccttgtaatttttctcaacaatatcatacgaatttttttctactctgatattaccattatgtgttgtcacaatcaacgggtgttaaagagattgccaagagaatcaattcagatatgttaaggctatttattctttctttttggcattatccaaatgatacaaacgaaacgagcaaatgcacaatttccataaatgactctgttcttagaaatactagagatgcctatgctcttgattccccatgtgtcctattattctattcatctgttcatgggtctcagaaaatccaagttgataaagtttatttcgtgacattaatcaaaggcataatggtcttatgacgttccaagaggttttattgacatacttctcatgcattgtattcatttacatgtacattgacccatgaccagatgttgttatatatccgtatatatgtatgcatatatatgtatatgggatatggaaaaaggttacggcgttatatatgcaccaccacctgatcaactggtatacattgatgattcacgcacagtggccgagatgatatgatgggatgccctgagaggcttgatgatgtaatgaacacatgtacttatgcacgatatcacattcatacgcatatgcatgaaactctaagtatttcatgagttgtagtgttatccagacttacatgtctagtcttttactccatgtttctctcaagtctattatttactgattttcattccttacatactcggtacattatttgtactgacgtacctttttcctagggacgttgcgtttcatgcccgcaggtcccattagaccggtcgagagtcctccaagtaggctatcagctcagtggaagatgttggtgcgctccatttgctccagagtttcttatttggtcgatatgatttggacgtgtattgtttagtatggtggggccctgtcctaacctttatggtatttatttactcttagaggcttgtagacatatgtcatgtgcataaaagattgtttggccttgtcggcctatgttctgtgtacgagtggtttttagttatataggcatgtatgtcttatgtataagatggtattacgtgttttattctagttatcctacggaagcctttccatctcattcacctataatagcatgatacgaaaagatatgttatgttggtggtctcttgagtaaggtacatagtgctcatcgcggaccatcggtttgggtcgtgataaaagtggtatcagagcagtgctgtcctatggagtctacaagccgtgtctagtagagtcatatttatgggtgtgtcgtgcaccacacgtataagcaggaggctacagggcatttaggactgtcactctttcttcttactccagatcgtgtggtagagctcagttgtaagaactcaatttcctaaactctatcttgttcataatacgataatggctacatccagaagggcggttggtaagggatatagctgtggaagagttgagttagaggaactcgatttttgaatcatgcttataatggataaatatgaggtattcagcagatcatgtgtgtagtaagatgtgtaagctgcttgataaggatccctaaggtaagaatatccatccacccatatggtgaaacgcaatgaaagattcagaaggtagatacaagcttcaacaagcaaaaggagcaagatgagaagggtacgaggtacccagttaatgaagattatcggtattttcaactcaggcagaaaaacataatcattgtgagttaccttcaacaataacaaaggtatgtacaattggtcacacctatttcaattatgccctatgggagctaacacgatatagtataagagaaggacggataccaggatccgactgaggttagagcgacccaaaatggtggatggattatttgcgttagttgacatttccgaaagatattgtaaatgtgctaatagatctcctagtgagacacccatatggtgcactctaaaatagtatagctggatacgagtactacaaagataggcactagaatcctgtaagggataaatattaccttagtatggttcccgtccctagtagagaaatatgttaggcaatccgaagagccactggatgaaacaaggggagctaaatgcaaaagaatgtcttgttgaacttttcaaaattaagtgatagacagaaatattagcagggaaataagaagagagttaataaagcattaggagtaagatgtgatacatggataacaatggtagaaaaaaatgacagtattatagagtctataatcaagtgaataagacgagaagtgacagaccttgagaaaacaaaagagtacatgccataaagtcatatcctcatttcgagaaataagttcgtgactccaacacaactaccagaagggagagttaaacccagagtaataaaaatcagtatgagctggtaaataagataaactaaacatgaattaaggactgaatgatttgataatagtcagcatcatgagaatttcatattgcgttccgacgataatagaatgaacaacagaagaagattcatgtgaaattcagagaatggtcattcaggaagacgcttccctaaagtaagaaatgtgagcaaagttaagcttaagggactgtatgtgcctgttacactaagtgtcaccatcgcgagtaaggtattttgttatccttggtacagaaggattaccgcaaggtgagtaagggtcatcgatgatgttaaaggatgccaaagatgaagaggtaaaacatctataggtaggtcgtcgtagctccaactcttaatactcccctaaagggggagagaggggatatggagttatgtggaattaagtcagaattaagtggttctggtaactatggaatggtaaaggaagaatgcgataaaaatgagaaagggatgagattatactgattcaaatcctatagatatgctacaattctagaacattatgcaaacacgatatcaaggagaggaagtaagggttccttcccgagatattattgatagataagaagccagtgggggatacaagttaagaaaaaggaaatgactcaagaaagattacacggaatattgatatgagaataggccaacgagtaattagtagttgattcaggaagagcctagtcatggctagataagaggttactgacaaatcaacaaatcatgcaagataaacatggtgaactccaacatggggaattcacgtctcgcagatatgccatcgggacccttgcgaaatattcagatatgagttgggttagttaaaggtatcgtatgagtattacgaaaataaaagagaatgctactgggaagtcagtaaaaacttcagtttagaagcaactgcacgagcacaaatgcacagaggtatgtaaatacaaatatttataggtgagtaagaacatcgaaaacttcttcgggtatacaatataacaagctcgcaatattacaagagttatagggtccttcctaagtaatacaatgaaagactagctgaggaagtaaggaggaaggcttcaacctaagctcagtgacctaaagaggaagcgatcttataacaacagtctcataacaatgttttatgcactccataagaaagtgtcacataccgtggctaatggacgggaggtaaaaatcagaagtgatattcaagatcatatgagttgcatggaattccaatatatatgggcactaaggtaagttaagtatgcacgcaacaagtggaagaacgaccaggaaaagcaattgcttgcatttaaagaaagttgagaaggaacgaaaggaattattcattcaatgatccagagataattacattttgaatgcacctaagatttcatagtattatccatgcagtatatatattgacaatcatacagccatagaagactctggtataagttaaatgaagaagggataagtcctcgggattaagcccatgagaacaagaattatagaaagctcagtatagcctgaatatactcaaaggagtcaaagactagtagaatttaaaggacatggaatgttgccatggtagtagaatacgggtgtaattgtgatagataaaggatgatgtttaggcctttgattgagtaatgatttgatgaattgtacaggattaaattacctcgtaaggaggatcacattgggatactatgaaatatggttattgaagtatagtatcgcccctaggtggattaggcaagccactttagatattctctgatgagacgtaagccctagtgataatgtattacataagaagtttcaacctatcagtggtggattgtagatcaacaatgaggtgaatcaacaatggatagataaaagttacaaagtatgagatgaaattgggccatcagtcttaagatgaatagtaatgaagaagcgttaaaggacttagatttatacatataagataagcaacgagaataacctggagtttggtagaaggcctcagtaacaataaatcgaagtaagagttattgtatagtatgacctacctagatacagtaaattcacgcggatggttaaccggggctatgaaacaagatataacaatagtcgtaagtttaataaagtaccaagcaaagaacttcagtgcacctatagatgcccagagggacatcttgtcaagttctacatatatatgtatgtatttatatgggatatgagaaaaggttacggcgttatatacgcaccaccacctgatcagttggtatacattgatgattcgcccacgtgacagagatgatatgacaggatgccctcagaggcttgatgatgttatgaacacatgtacctatgcacgtcatgatatttatacgcatatgcatgacactctaattatttcatgacttgcagagttatccagacttacatgtctagtcttttattccatgtttctctcatgtctattatttactaattttcattccttacatactgtacattatatgaactcacatcccttttgcttggggacactgtgtttcatgcccgcaagtcttgatagacaactcgagagtcctccaagtaggctatcagctcagcggaaaattttggtgcgctccatttactacggagttgattatttggtcagtatgatttggacgtgtattgtttagtatggcgggatcctgtcccaacctttatggtatttatctactcttagaggcttgtagacatatgtcatgtacgtaaatgattgtatggtcttgttggcctatgttcagtgtacgagtggttattttggtcatataggcctgtatgtcttatgtataagatgatattacatattttattctagttatcccacggctcctttccgtctcattcacctatgatagcatgatacgaaaagatatgttatattggtgctcggttaagtaaggtaccgggtactcgtcgctgcccatcagtatggatcatgacaaaagtagttcagagcagttatgtcctatggagtctataagccgtgtctagtagagtcttatttatgtgtatgtcgtgcaccacacttattagcaggaggatacaaagcatttaggactgtcactctttcttcttactatagatcgtttggtagagctcagttgtaagaactcaatttcctaaactctatcttgttcataatacgacgatgcctatatccagaagggtgcaccaacattgtcacgtcccggacttcccactctcaggagtcgtaatggtgcctactcgtgaaagttagacaagtcgagtattatatatcttattaccctttttcttaaccttttagcaattttaaatcaacatgcgattaacagcggaataatagtaattataaaagaaatgcggaagacgaaatctgataacttagccaaatactagtacgaaacattcaaaatacatctctacccagaactggtgtcataatatcacggaccatctacgaatactacaaacaattatctgaaaagaaagatacattctgtctcagaaataaatgaaaacagaatttaaaagatagaaggggatgacaagtcctgcggacatttgtaggactacctcgggcctccgctggactgaaggcagcaaccactctaaggtccaaaagctctggtaccgagatctgtacacaatgtagagagtagtatcagtacaatcgaccccatgtgctggtaagtgtcgagcctaacctcggcgaagtagtgacaaggctaggacgagactaccaaataaacctgtgcacttaaagtatacacgacaagtaataataatgaaaactagcagttaaatatgggaagggggacatgatgcggggaatatcgagtaccaatagtaactcaggagaaaagcataaagaacgtcttaaagttcgcatcagtaagaagaaagaaatagtaatgaatcaatatccatttttattcaatattgttgctgcgcgcaacccgatccaaatcatataacactgttgtggcgtgcaatccgatccaaatataatattatggtgccatgcgacccaacccctcttgttctcccttattactccatgttgcggcatgcaacccaatcccatataatattgttgcagcgtgcaacccgatcccaatatacaaatcaacactaatcacaaaagaatctcggcaagggaacaataaggaaacaataatatcccggcaagggaatcaactataagaataaacacatcccggcaaggaaactaacaataagaattaaatatgtcccggcaagggaatcggctataaccaatcttgtaccaacaattaacttcacatataaaatctcaactggaacccaacaatgaataattaccacgagcataatcacaatttttgtccaacacggagaatcaacaacttaggcattcgtagtactcattaagaaactcagcgattacaacttaagactcacggacatgcttgacaacgacgtatagatactcgtcaccatacctatacgtcgtacactacactagcacatagcaaataaagctaaggttagaccaaacacttatgtgacgacctaaagggtcatcacctattttcttacttatgttgcatctctgaggccttgaaaacctcatttagggttgcctcgaattgcgtgtacagtccgttcgcaaagccggaaagcttaaatatgagttatgtgtgataaatggtgaattttgatattaatatgcataatattgactttggtcaatattttgggtaaacggacccggaaccatgattcgactatcccagagggtccgtagaaaaatatgggacttgaacgtgtgccccgaatcgaatttcgaggtcccaagcccgataaataaatttttgtgtgaaattattttctgtaattaattaaggaaattggaaaagaaaattgatcagaaaactatggtatcgggatcgtattttggttccgacgtccggtacgagtcttatatatatgttaagagccttctataaagtttggttgagaacggacgtcaattgacgtgtttcggacttaaaatgaaaaattagagttttatgaagttcaaagaaaatcatgtgttttgaggcttgattctacgtatatgatgttattttggtgatttgatcgcacgagtgaatccgtaggatgttttcgaggttgtgtgtatgtttgatttggagccccgagggctcgggtgagttttggattggtgtcggagtatatttttgaacttggaagaaatctggagtctcagttatgtaggcttcgtgtcacgaccctagttcaccaatcgtgaacctgtcatgacggcacctagtcttcacgactaggtaagcgtatctcgttgcggaatctaacaatttgtaataaaaatagtaaataaacactaagtattataagaaatgtatacggtgccgcttggcacatacactgaaacacaacttctgaaaataatatcccaaaacccggaatcccacgggcaacataggctatgagaaacgtaaatacagctctaatgtctgagaagtctaatacaatggaaaacagtaggaaaacagtcctgctaactaagatagaatggacggagactctccgatctgcggatgcagcagatatacctcaagtctccgatagcaagctccggactcactgatgatgcgcctggccggatgtacctggatctgcacaacaaaagtgtgtagaagagtagcatgagtacaccacagctgtactcagtaagtgccaagcctaaccttggttgagtagtgacgagggaggtcgaggccctactgagatcaatataataataatcaatgtaaaatgaataaccaaaagagtacagctatagagaatctaacaagataatatgtaaacggaaacaggttatatgtacagtctatgagtaaaagaacaaccaactgtctatcccgaggatctccctgtatcctcatcataaccacgagggatctccaagtatctcgaggatctcccagtatcctccgtttattgtcaactctgagacggggatctcttagtatcccacacacccaattttacacagaatacgtaaaggggaactcccgggatgccgtctcgtagtcccaacttgtaaacacatcacagcaatttaatattgtacaaatgctaagtaaaggtaacaagtagaatctagagtctagcatgcttcacagaaagcaggtattgcagctaagtcaaagaaggcaaacaaatcaactaacatgctttccctacactatcacaggtaaaacttgcatttaaacagtctattaagcgaaaaaaatacagtctacgtaattcaagtaaagtgaatttccaacaattagcaaaagtacactatcgtcacctcgcgcacaaggcatttaaaatagcagtcaagatatcctaagggaagaagtcccccacacaaggttagacaagccacttacctcgaaccggtacaaaaatcactacaaagcgatgcccttgccacgagtatccaactccgaatggcacgaatctattcaaactaattacataatgtaaataacatcgcaagtaactaattacactattaaagttaaagctacggcacgaaaataggtaaataaccaaaatgccccttaggccaacgtctcggaatcgaataatctttacattttcagaaacctcgtactctcacgagtctaaccatataaaattctcccaaatcggaggtcaaatgcctcttcaaatcatcaaagttagatctaagaactttaccccaattttcattcaaaatccgaaattaaaggttgaattcgagattagattagtgggtaataatcataagggagtaaggaatcgttacccaatctttgcctctgaaaaaccctcaaaaaatctcccaaaactgagctctctagcttgagtttttgtaaaaatggaagaagggttcgttttgaaatgtttatatctgcccagggattttgttcaatgcgatcgcatgaatagggatgcgatcgcgtagaaggaattttgaaggcctgggaattggcctatacgatcgcgaagtgaaggatgcgatcgcgtaagagggcaaggcagagctatgcgatcgcgtaaggacccctgcgatcgcataaaggaaatggacccctgagccaccagctgtatttgttcagtgcgaacgcgtagaagaaggtgcgatcgcagagaagaaggaagcaaacctatgcgatcgcgtacaagaagttgtgattgcattgaaggaaaagagggccttccacaaaagcactacgtgatcgcatgaagacctatgcgattgcagagaagaactggcctacaacacacagcagattttctgcaatgttctaagttccggaattgctccgttgatcatccgaaacacacccgaggcccctgggacctcaaccaaacctacggacatatcccatagcatcattcgaacttgtaccaattcttaaaccacctaaaacaacgccggaaactcgaattaatcaatgatttgcacttaaaaacttcaaaacttaaccaaactcgctttcgatcaaaaacctaaccaaaacacatccgattgacctgaaattttgcacgcacgtcccaaatgacatgacggtgctacagaaacttccggaatcccgttccgaccctcggatcaaaaattcactatcggaccggaaactccaaaattctaactttcggcatttctagcctagttgagctacggacatccgaaacacattccggacacgctcccaaccccaaaatcacctaacagagctaacggaaccatcagatttccattccgaggtcgtcttgacactgttccgactacggatattttccaactcttaagctctcatttagggactaagtgtcccaaaacactctgaattcacgtaccgaatatcccggtcaaagcaaaatagcagaaatgaacttaggggaagtagttaatggggaaagggggcgcaaattctaaaagcgaccggccggatcgttacatcctcccacacttaaacattcgttcatcctcgaacgagcatagagaacatacctgaagtagcaaaaagatgagggtaacggctgcgcatatcccgctcggtctcccaagtcgcctcctcgaccggctagccccgctactgaactttcactgaggctatctcctttgacctgcgctttcgaacctgcctgtccaatattgccactggctcaacataggacaagtccttgtccaactgaactgaagtgaactccaacacatgagacggatcaccgtgatacctccgaagcatcgagacatgaaataccggatgaaccccggccaaactgtaaggtaaggcaagctcataagcaacctccccaactcgcctcaaaatctcaaaagggccaataaacctcggactcaactttcccttcttcccaaacctcatgacgcctttcataggcgagaaccgaagcagaacccgctcaccaaccataaaggaaacatcgcgaaccttccagtccgcataactcttctgtttggactgggctgtacgtagtcgatcctgaatcaccttaaccttttctaccgcatcctgtaccaagtctgtacccaatagtctcgcgtaactcggctcaaaccaacccaccggaggtctgcatctcctaccatataaaacctcatacggcgccatctggatgctagactgataactattattgtaagcaaactccgccaatggcaagaactgatcccaagaccccctaaactcaatcacgcacgcacggagcatatccttaagaatctgagtagtgcgatcggactgcccgtccgtgtaagggtgaaatgctgtactcatagtcacctgagtgcctaactcttgctgaacggttttccagaatcgtgatgtaaattgaggacccctgtccgagatgatagtaaatggaataccgtgcagacgaacaatcttcctgatataaatccccgctaaccgctccgctgagtaagtagtacacactggaatgaaatgagtggacttggtcagccgatccacaataacccaaatagaatcaaatttcttcgcattcaacgggagaccaactacgaaatccatggtgattttctcccatttccactcaggaatctcaatctgctgaagtaatccacccggcctatgatgctcagcctttacctgctgacagttgaggcatctagctacaaattccactatgcctttcttcatccgcctccaccaataatgttgtctcaaatcctgatacatcttcgcggcacccggatggatggaataccgcgaactatgagcctctgccaatatcaactcccgaatatcatcaatatcgggtacacagatccgaccctgcatcctcaataccccgtcctctccaatagacacatctctggcatcgccaagctcaaccctaccccgaagatcaagtaaatgggggtcatcatactgccgctccctgatacggtcaaacaatatggaccgagagaccacacaagctagaacccgactgggctccgaaagatccaatctcacgaactgactggctaaggcctgaatatccatcgccataggcctctcagctgctggtagatatgccaaactacccaaactctccgcccggcgactcaaagcatcgccaccacattggccttgcccgggtgatacagaatagtgatgtcgtaatctttcaacaactccatccatctcctctggcgcaaatttagatccttttgcttgatcaagtgctgcaagctccgatgatccgtataaatctcacaaggcatgccatataaatagtgacgccagatcttcaaggcatgaacaatagcagctaactcaagatcatgaacatggtaattcttctcatgtaccttcaactgtttggacgcgtaggcaatcaccctaccatcctgcatcaataccgcccccagaccaatcctcgaggcatcacaatagacagtataagagcccgaacttgtaggcaaaataagaactggggctgtagtcaatgatgtcttgagcttctgaaagctcgcctcgcactcttccgtccattggaacggagcacccttctaggtcagtctagtcataggtgctgtgatagaagaaaacccctcaacaaatcgacggtaataacccgccaagccaggaaaactgcgaatctcagtcgcggaggaaggtctaggccaactctgcaccgcctctaccttcttcagatcaacccgaataccctcgctcgacactacgtgacccaagaaggccacagaatccaaccagaactcacattttgagaactttgcatacaacttcttttctctcaaagcctgaagcactgtcctcaagtactgctcgtgctcctcccgactccgggagtaaacaaaaatatcgtctatgaaaacaataacaaacaagtcgaggtatggccggaacacactatgcatcaagtgcatgaaggctgctggggcattggtcagcccaaaagacataactggaaactcatagtggccatatcgagtcctgaaggcagtcttcgggatatccggctcctgaatctttaactgatggtaccctgagcgcaaatcaatcttagaaaatacccatgcgccctgaagctggtcaaatagatcatcaatacgaggcaaaggataacggttcttcaccgtaaccttattcaactgacgataatcaatgcacatgcgcatagaaccatcctttttcttcacaaacaagataggagcacccaacggtgaaacactggggcgaataaagcctatatcaagcatctcctgcaactgatccttcaactccttcaactccttcaactcaggaggatccatacggtaaggaggaatagatatgggctgaatgctcggcaacaaatcaataccaaaattgatgtcccgatcgggcggtattcccggaagatcagctggtaaaatatcgggatagtcccgtactacggggatagaatcaacagaaggggtatcaacactaacatctcgcacataagccaaatacgcggcacaccccttctcaaccatacgttaagccttaagataagagataactctactgggagtgtgatcaaaagtaccactccactcaatatgagtaatacctagcatagccagcgtcacggtcttagcgtgacaatcaagaatggcaaaatggggtgacaaccggtccatgcccaagataatatcaaaatccaccatgtggagtaataaaagatctgctctggtctcaaaaccacggatagtaaccaaacacgaccgataaatgcggtccacaacaagagaatctcccacaggattagaaacataaataggagaactcaaagaatcccgggctacgcccaaatatggagcaaaataagaagacacataaaaataagtagagcctggatcgaatagaaccgatgcatctcgctgacagactagtataataactgtgatgacagaatcagaggcaacaacctcagtacgagcaggcatggcataatatcgggcctggcctccccctcgagggcggcctctacctccccgacctctgcccctggctggctgggcaggtggggtggcagctggagctgaaacaatagcctgggaactctactgatcacgctgctactggtgatgctgtggaggtgcactcctcccaagcctagggcaatcttgcaccacatggcgggtatccccgcactcataacaagctctgggagggcgcggaggctggggctgactgggtccacccctgctggactgtcctctataagcgccccgcgcaggaggcgcgctagaaaccggaggtgcatagtaaggctcctgagatctgggaggagctgaagtgccgctggatgaaggaagtgctgagtgaactgggcgacccatatagcccctaacgtgatgacctgctgccggggtccgggtaccagagtagcgaaccgactctcgagacctcttggcctccttctcatctcgctctctagtaagaagaccctcaatcctcctagcaatacccactacctgctggtaaggaatgtccatctcaagctctcaggccatgctagatctgataggagaaataagaccctcaatgaacctgcgaaccctctcgcaaaccgtggcaaccaaagcaggtgcatgcctagccaacctggtataatggatggcatactcagaaactatcatagtgccctggcgcagatgctcaaaatcctcacgccaagcatccctgaggctctggggaacaaactccctctcaaacatagcaaaaaactgtgcccaggtcagggaggcagcctggtccggactgtctagctcaaatgtatgccaccaatcataggcagctctccgaagctggaaagctgcaaaggaaaccccactcgtagcagtgatacccatagtgcggaaaatgcgatgacagtcctccaaatatcccaaggcatcctccatggctaatccgctgaacaccggagggtcatacttcttgaacctctctagcctctgctgctcatcctctgaggcaagtgcctcatcccctagctgaaccggtgttgcaggctggacatgaatgatatccggggcctgctcgacatgcactcgctgctcgggagtgcggccggcgggagtctgtgctcctcccccggcctgggaagtggctgcaggaaggggaaacaaccctgcctatgacagcgcagtataagcactcataaactgggccagtgcctcctgaacagctggagtagtatggctgtgggtgtgtcaggtgtgtgagcctcgactggaacggctggcggtacctcagcggcagctcacgcaggtgctctggctgcaccacgtgcgcgtccacgacctcggccccggcccctgcctctaacggttgcaggagggggtgcgggtgcctgattatcctgggtcgtgcgtgtcctcaccatctgtgagagaatataaagacagaagttagaattggtgtccaaaaatatcgcacgacaaggaatcaaatgaagtgaagatttttttccctaaacagttacataacccctcgtagataagtatagacgcccccgtaccgatcagcgaggttctaataaacaggcctgtgtcccatgactcctatgaacctagagctttgataccaacttgtcacgaccctagttcaccaatcgtgaacctgtcatgacggcacctagtcttcacgactaggtaagcctatctcgttgcggaatctaacaatttgtaataaaaatagtaaataaacactaagtattataagaaatgtatacggtgccacttggcacatacattgaaacacaacttctgaaaataatatcccaaaattcggaatcccacgggcaacacaggctatgaaaaacgtaaatacaactctaatgtctgagaagtctaatacaacggaaaacagtaggaaaacagtactgctaactaagatagaatggacagagactctccggtctgcggacgcagcagatatacctcaagtctccgatagcaagctccggactcattgatgatgcgcctggccggatgtacctggatctgcacaataaaagtgtgcagaagagtagcatgagtacaccacagcggtactcagtaagtgccaagcctaacctcggttgagtagtgacgagggaggtagaggccctactgagatcaatataataataatcaatgtaaaatgaataaccaaaaaagtacagctatatagaatctaacaagataatatgtaaacggaaacaggttatatgtacagtctatgagtaaaagaacaaccaactgtctatcccgaggatcttccggtatcctcatcataaccacgagggatctccaagtatcccgaggatcttccagtatcctccgtttattgtcaactctgtgccggggatctcttagtatcccgcactcctaattttacacacaatacgcacatgggaactcccgggatgccgtcccgtagtcccaaattgtaaacacatcacaacaatttaatattgtacaaatgctaagtaaaggtaacaagtagaatctagagtctagcatgcttcacagagagcatgtattgcagctaagtcaaataaggcaaacaaatcaaccatcatgttttccctatactatcacaggtaaaacttgcatttaaacagtatattaagagaaaaaaatacagtctaagtaattcaagtaaagtgaattttcaacaattagtacaagtacacgctcgtcacctcgcgcacaaggcatttaaaatagcagtcaagattgttgacgccccctttttcaaaagcgaaatcgggtttacgacattatgggcaaaacaactctcattcccgtttaggaattgggttatggaattagaagagtcgccacccaatgattatagtgcattaggatactttaagatgaagagagtgttttttgaagagaaaaccagagttgggtaaaggcttgaggttatctcgaggggaaggtgttaggcacccctcaagatccacaaatatggttcccggccgtgctaattgtgactttaaaagaacatgaaacaagtaggcaaataaggtgcacatatataacatttatataacttgaaatctttaaagaaaaggaaggacacaaatttgacataagagaggagtagtttgaaaagcattaagaaagcatttagataaagcaaataaagaagaagaagggtcctaggtttaacaataatatggatcacatcggcacaataccccacacacactcctcaaagaggggtcgcatatggtattagcgtaccagtcatcatctccatattctaccctcccaccccgttaaggtattaaaacgtattggtatcgtttacttattgcatgctaatacccgtctcaacctgttagtcctggggtattaggacttctaatcctaagaagggggagaaggagataggatatatatatggagtattcaaaggtaaaaatactagagcgacagtcaaaaacaagtaacatacaagggggatgcaaataaataattaaaggctcaaataaaccccgtaacatacagcaagtagtttagcatgacttcagttactgatttggtctttaaaagaggttagggggagcgggcagattagtttaacacataagagttggatagaaaatctgcttcgagctccccgggcccgttttagaagttgttagacttttaggaaatcagtaggactttttgaaaaaaatactagtcgcggacaggagtctgttttaaaatatttagagttacaggcgagttttagaaaagaaaagtgcaagcttcaaacagaagcctgtttaaaggattaaagttgcagacaagttttgaagaaaaggcctgtaaatcagtcgtataagctgagtaaagagagctgttagaagaggagttcaaaaccttaaagaagtttttaaaatcttaaagcagtggatctaagcaagcaagcaatcacaagttcaatgtagaaaatagctttatatgttcagaacatttacgaaaaagggcagacctgggctggacccgttttaaaataagccgagttaggacaagtttgcagaaactgagacgtttgaaggcattagcgggtttgaacttatgacttgtttattaccctttagttacagttttacataattagacgtcctactgttttgcctagcgtttatatagttcctataggcatgctttctaggtgagattataaaatgcgaacctaatagcatgatttctatatgaagttgatacagtacgaaaagcctatggacatggtatctatatggttgatgcaacgacataaaaataggcatggtaatagtatacatggataaaataaaggtcctaagatgtggtttgatgcaaagatgaataaacctatagtcatgattactatatgatactgatgcaatagtgagaaagctacggacatgatatctaaaaatgcaatcctataagcatgatctctaatgcatgtgagaaaagtaaatcccccatgcccctttcactatacccccgagttcttacattacaagttattacaaaactgggcaaaggagtaaacaacattaaagaagtaaaaagttgaaaatacatcagcagctataacaggcccgaggagtctcgaagcaattttaatgtccaacatatgccttttaccaaatctgagctcccaagatccgaggcttttctcttttagagtgttacaaagttccaaaggccttcaaagagacccaggcattgcttacaccctaattggaatagtgcaagtgtggaattaccaaccctaaggcatccaagttcagaggagactccagggtccctaagcatggcttacccaaggggggtaggaacttaaaggataagaataagtgcaaagtgaggatcagaggggaaaccagtgtatgaagtggtcatacctagcctattgaatgagactggcacaccccagactccttacaaaggttgcaaacaggagcagacttgtaaacaagtcagacaagggcctggaaggtgattaggacaccaacaggcctttatcaaggctcaaacacataagagaggggaaagggagtgggatcattctgagtataggcaattaaagccttggttctagattagaagtagcaatgaagtgccattctcatccacaactaactcataagcaaacaaggactaaagggaaaggaaaatcatataaaggtatttaaagaacaagattaaaatgacccaagaaaccctctgaataacaagcaagcaaggaaaaggaaagggatgctagtcttactgaaatataaacaatcaaagggacagggaaaggggatcaatatgcagaaatttaaatacacaagcaggtaagagacaagggaaaagagttgaacatattgaaataataaaacagacaagggaatgagggaagggattaagcaggctagaaaaactgaaatgcataagcagacaagggaaacaactaaggattaaacatgctgaaagtataacagactgagaacaagatgaagtaaacaggtaactgaaggttggtaattaaaattggaagcctaccagttcaactggaataacagagcaagtgtgagtccttataattagccttggctttcagccggcttattcttagcaaagagagcaagtaacagagaagagaagagagtttgtagtgagtaagagtatagagaggtcgtgtatcagtgtgtgtgttgaactaaagttgttcgtgtcttttatagtttgaaaacaggcaagaaaataaggcaaaaataattcagtaccaattagaatcaatcagaggaagggaactcctttaattaaggagttcgaattcgaataggagaggacagagttgtatttaaggaaagaaaatcaataacacatggtgcaatcaagggtaaatacatgagagaagcttttaaaactacacggttaggtaaataacgtaaaggctaaatcaattatcacctagtaaatcaaggattcaaagattcatacttaataatgaactaagtcaataataggtccagatcaaatgagggaagaatcaaataaggttacatagaaaatcaatccccaaaaattagggttattttgaaaggaatagcctgactataaagagatgcacagatttaaacatgcgaggctaaaaaaaataaacagagtagaagagcacagtcacgagatccataggtcttgcaaagcttagcaagaatcagagagtttagagagttagggtttcgaaatcaaacaggcagcaaacaatcacacacaaatggtgtgaaacccccaaaatcgagggtttcttccacaagtcaagtctaaagatgaaatcatagcggatcagtcaaagaataaactcaaaaagtccaaagaacacaaacattcatggaagcttaatgaaagaagaacagtaaagaaactactcgaaaaccctagaaaaaaatacagtgaggagaatacatagaaaaaacagataaacacttaggaattacagcaaagtaaaataatggaagaaatcacagtaagtcaagtagaaatcacggaaaccctaagtcttgagaagacgaacagtttttcaaaacacgactaggtgaagaaaaagatgagagatacttaaaaatattagaaaacaaacaaaactcagagaagatcataggataaacacggaaaaatgaaaaagaacctcgaatcattagggttttcagagaaaggcctagaaatggtgagaaaagcctgaacggctcatcggagttggcaaggacccaaggcttcaaagacttgccggagaacagccgtggaactccattgaaggacccctggtccagtaaccctcgaaacaaagtcccgatcttcaaacccaaaggccaggaaaggtgatgcgtggacgggcatggaagtttcaggccttgaacggccattaaatcccgtgtagaggaccagagaagattagggttctcagagaacctagagagcatttgggagtgaaaggcggaggattggtgaaagtgagtatagggttaagggtttggggggtttaatttggtaagtaatgatatgggccgttgatctatgagatcaacggccaggattagaagggtgaaccgggcaggtttagtttagattgggtttgggtcggatattttaaattgggtcaggtgaatagggtttaagaatggggttgatatgggttccaatttaggctagaattgaaagagtaaagggttacaatttaaatagcccctttttcccaaatttaattttataaaaatggtaaacaatttataaaaatccgataaaattactgagataataaaatacgtttaggaattaattaaaaatatcaggaacgattttgcacttgaaatacttattaaatttagaaataggctaaaattgcaatttaatgcaattctagttttaaagtacctaatggctttgtaaaatcctgtaaaaattacataaattatattttatataaatgagagaataaaataatttattcgttaaaataacaagatttggtgctaaatattagatttttatagtacaaaataagttgtaaattggttttaaaatgcttaaaaaattatagaaagataccaaacctcttgtggatgcttatatatgcattcacaagcaattttgaaagtattttggttataaaatatataggaaaaaattgggtatcaacagctggccctctttacccaaggaggatgaaagagttgtcgggtaaagataagatggccaattttgaccggaagtggcggttgtaagagaatttcgaccgtgatctggcttctgagctgcctacatatccctggttttacaggaatcaggtcgtatgtagttcaggagccattggcggagtatgccaacgaaaattttaaaaaggcggacgcaacagaggtttgagatttggcaagggttcggagaacggacaggccgcgtagaactggagcggaagcgctcctgctgaggcagccgtgccagccggtgtacctgcaaatgaacgatgtgcgtgtatattgcataatttaaatgtgatgcaagttcccattggaccatgaatgctgtctttggacgatcagggtggcgtcctcagactatgacatccgggctatgaagagcataaaagtaaagattcgcaggccatgaaatggtgttctcgggctatgcagatggtgcctccgaactatgacgcctttgaataagttggcgatatttcagcccatgaaaaggcggcaatatttcagccgaatgaatgcaaagggtggcgatctttcagccgagtaggaacttaaaatgcagggtggcgatatttcagccgaaatgaaacagggtggcgatatttcagccaaatgcaaaataaaggaggcagagcttagcctcgaaaggcagaggatagccttatgcaagatggaggtagagcttaacctcagaaggcatggaatagccttatgcaaatgcaaagacggagacagagcttagtctcgaaaggcagaagatagccttatgcaggatggaggcagagcttagcctcggaaggcagagaatagcctcatgcaaatgcaaagacggagacagagcttagtctcgaaaggcagaagatagccttatgcaggatggaggcagagcttagcctcggaaggcagagaatagccttatgcaaaatgcaagaaatgcaagatggagacagggcttagtctcgaaagaccgcggatagccttatgcaggatggaggcagagcttagcctcggaaggcagagaatagccttatgcaaaaatgcaagaaatgcaagatggagacagggcttagtctcgaaaggccgcggatagccttatgcagaatgcagatggagatagggcttagtctcgaaaggccgcggatagccttatgcaggatggaggcagagcttagcctcggaaggcagaaaatagccttatgcaatgcaagaagtaaaggaggagatagtagtgattttcttagctgggatgactgcgatatcatgactgctggggaaatgttggatgtagatagtaaacctttgtgaagtaagtagttgtttcgggagtttctgttctgtgaagcacatgcctcgcccattggtatcctgaattcctgcatccaaagtaaaatcatgagttctgtaaagggggaggttagttcgcatctctcggcccgtggcgtcttgtactatttggggtagcgttgctgaacgatagaggtccaaataattttatgcaaattttggaaaacatgatgcaaatgtacatatataggaaaagaaaagatagttttgttttaagatgaaccaacaactgcaacgtggttcaaagcatggcaaccttgctggttctggaattttgagggtcctcctcaaaattctgtcccagtctactgggctggcgctattgacggcggtgctgaatagctgaaaagcagattgacctcggaattttaagggtcctcctcaaaattctgccccaatttactaggttgatgctgatgcgggaactaacaaactgacttcggaattttgagggtcctcctcaaaattctgccccagttccaatagcggggggaaatggaattttattaaaaatgtgaccgaacccatagggctgcctacgtatcccctcttaaacgggaatcaggtcaggcgtagttcaaattacatcatacagaaagcacaaggactaaatgtagtatcttttcactgcgtctgagttgatcggttttggccaaacttctccgtccatttctgcgagaataagggcccctccagttagaacccggtgaaccatgtatggacctttccagttgggagagaatttccctttggcttcatcttgatgtgggaatatcttctttaacaccagctgtcccggtgtgaatttccttggtcgggctctcttgttgaaggctctggacattatgttctggtatagctgaccgtggcaaaccgcattcattctctttccatctataagggctaattgctcgtagcgacccttgacccattctgcgtcatccaacttgcctcttgtatgattctcaatgatagaatttctacctcggcagggataaccgcctctgtaccgtaaaccagcatgtagggagttgccccggttgaggtgcgaactgtagtacggtaacccaatagagcaaatgatagcttctcatgccactgcttgtgcttttcaatcattttcctcagtatcttcttgatattcttgtttgcagcttctacggctccattcatctggggtctataagctgtagaatttctgtgcctgatccggaaagttttgcacattgctctcatcaaatcgctgttgaggttggaaccattatcagtgatgattgattcaggaatcccgaaccgacagataatagatcttggacaaaggtctgccacgactttcttagttactgctttgtgtgaggctgcttcgacccatttagtgaagtaatcaattgccactaagatgaaccagtgttcgtttgatgcggcaggctcgattggtccaataacatccattccccaggcggcaaatggccacggtgagctcgttgcagtgagctcgttcggaggtacctttatcatatctgcatgtatctgacagcggtgacactttcagacatactggatgcagtccgtctccatagtcatccaaaaataccctgctcggagtatcttctttgctaaaacaaagccattcatgtgcggcccgcaggtccctgagtgcacttcctccaacaacttggttgcttctgtcgcgtcgacacacctcaatagtcccaaatcgagagtcctcctatacaggattcctccgctgtgaaagaaattatcggacaatctctgaagcatgcgcttctgggtagcattagcaagctctggatactctcttgttgttaggtactctttgatgtcatgaaaccaaggctttccatcggcttcttcctcaacatgcgcacaatatgctggctgatcatgaatcttgacatgtatgggattaatgaaattcgtatctggatgctgaatcatggatgatatggtggctagtgcatctgcgaactcattcggtactctcggaacatgctggaattccgtctttctgaacctcttcctcaactcttgtatgtaatgcagatacaagagtatcttggaattcttggtagcccattcttctcgaacctggtgtatgagtaggtccgaatcttcaataactagtgtcgcacctcctttttacgcatccgcgagggcgcaagggagtttttccaattaaaggacaatcgaaacgggatttattattaaagattcagagtcgccacttgggagattaagggtgtcccaagtcaccagttttaatcccgaatcgaggaaaagaatgactctgtttaacagtttgcgtaccagaaatctggataaggaattttgttaacccgggagaaggtgttaggcattcccgagttccgtggttctagcacggtcgctcaactgtcatattcggcttaattatctgattttttacaattatgaacttatatgcaaattttaacttttaaccgcttttattattatttatttatttaaaagaattgcaacgtcatgagaatatatctcgaactgcatcacataaatgtatccgcaatttttaatatattccgacttcgttgagatttggatttgggtcacataaatgtatacccgagtttagggaagataacatcattaaacacgcgcctaaagatgctaccgcgttattattttgagaaaagccgtgaaattcgctatacgacttgtctcgaaatctaagcaatgcttattgagggccccgcaatttgtacattttattcgacgaggctcatctcgtttattttaaggatatcctaaagtgactacattttctattaatggcgtctctaaaagtaatgagaaagtcctaattaattacatgcttaaaaatataacatattaattgttagacgaagacaaatattaacggaaagaaaataaaataaaataaatagaaattcgaaattaaaataaaataaaaacaaaaatttcgaaatttataaataaattacgaaattcgataactaatattcgaaagaaattgattatagctagattaaaactcacataattacgtaaaactgttgaaattaaatattcacaattatttgcaactaaatttaaccataattactagagcttattagaaagctattaaacttaaacattaactcggcttgctcgaactcaaatcattccttaatgcctaattcacgaaattaattcaaattaaaaccttaaaaagatttagctacatgttcgcgattaacctactattgacaacatcaaaacctacacaattagtgaattgaacagcttgaccaagccgattcaataaagatcaactcatactatttcttcttattccaattattaaacagtttgacagtaatgaacatgcttgaacatatattacctactaaccaaattaaaacagaatattatttaatacatcactacaagctgtcaagtcatacgaacatggcagaaacttatataacaatagtatatagcttggcctaaatacattaaataacaaaactaaataaaattaaaacttcaactcttcatttgtattcatgcttcatgttatcaacttacaaggtgtatcagttgtgtacctggttttggaatacaagaagaggaagatcagtagtgcagcaatagcacaacacagcaacaacaattcagcaacaagtggaacaatagcagaacccagtaccagattgaaaaccaaacagaatgacccaaacaacagaaaaaccacagcaaccagatgtgaaccgggaaaacaccaaaataaataacaccaggcagaaatagaaagaaccaaaagcaagagatgcaatggaacaattctgattttttatcttttaacactcaaaatataacactttaactgaattccaagattttaaaagtcagttaaatttttactctctaaactctgaatttttgatgtcaaaatccagcctaacacttaacagccttcactctctattttttctctgaacatttttcaatctctcttttttcagattttcagattgttctcctcttttcagattattctcctcctttcagattattctctcttttcaaatttcagattctctttttcttccttaatgttctcctcccttaactctctgttttcaaccctttttataacaagtaacagaccgttctgaacacttaatcaaagaaaatttctgctcaccaactcccactaagctattttgtcatttaaaaaaactaatctacctcctacccacagtagtaacccctaaattaccccctagccacttagcagcccctagattacccctaatcagctataaccaaactcctaatcaccattcaaacagtgacctaattaaatcaggcaattaacagttagagaaatataaacaatcagaatgccaaatgattcaaatatatacgcaaacgacctaatcgatgaagcataatcaactgattacaaacaatcagaaaaaaaaacagataagcatgtgattcggatgattttgaacagaacatggagctaatatagaactgattaatcgacgacctttaacgaatcgattacacataacaactagcaacgaacaagaaacaatcagaaacaaaaaattcacatggttttcggcctaaactggggaaacatgaaactaatttttcgacgatgttaaatcgaatcgattaagtagttcacaaccaacccctactaataataatcagcaacgacgagtcgaccaaataaaaaggtcccaggcagaagaagagaagaagaagcaatgaaattaaacgagattataactaaactttaaacaaataacagtaacagaaaatagaacaaaggcaaggaacgaaataccttgagaaatcagaaaacttggatggacccaggtcgaacggactcgagttctttgaggtcgaacagaccttagccaaggtgttctcaattgagaacaccttaactaaagtcaattaaaccccaaatcttcaactacttcggacaaaccccaagctttggagttctagggttcatgcggccaatttggggttcgaccctttcaagttagattcgaactaaaccaagagtggtttggtgactagggaagtcagggggtgccatggcatgaatttggggccggttgggatagtttgaggtttggctcgaatcttagattgaagattcgagcaagctggggatgattcgaaggataaggagcggggattcggaaagaggagggcgagggggatcaggggtgttaatttgggtatgtttggccaccgtccaccgccgtgaggcgattttcggtgggcggagctcggcggtttggggcggagctacagggagggtctctgaggttagagagatgaatgagagagaaggaggggtgtgtggaaatgagaggggtaggggatttgagggtttgggtaattaaaattggttcaataaatcggggccgttggatcaaggatgatcaacggccctgatcatttctctcatttaaaacggggtcgtttagattagtggggaggtgggtcggtccgggtccaggtgggtcgggtagacgggtggtgatgtggaccgttagatcacacatttggacggctgagatcatcgttacaaaaacgatgccgtatgggtgcaagctcaattgagctgacctgggtcggccctgggttgtatatattgggcctgatttcatttaaaatatagccattttccttctttcttccaattttaattaagctagcctcttttcacatatagccacattggctttatacaattttgtgcaactttgcacacattaatcaaatataaaaatgaaaactattaaacatttaacacacaaaattaacatacattacgcatttaaataacacaaattgcacatttagacacaattgcacaaagaccgcacactttcgcgaattcctttcgatctacttgtgatcaattaattctgaaagcacactattagcttctaatgcatgtgacacatatttttgtattttttaattaattttaacaaataaacacgcacagacaaatgcaaacgctaaagaaaagataacacaaaaatccataaaaatcacacacaacacaaaactattttttttttgaatttttgggagtaattgtcgcgagagcaaaaatcacgtgctcacagctgcccctctttgtccgaaaacacaaagagctttgtgttttcgtgcaaagataaagtgagcggatacgagcgatttttgcccgttggaatactccgtgtgaagcatttttttttaaaaaagatttaaccgaacctttgcttcaaaggcttcctacatatccctggctaaaagggaatcaggttaatgtagttcgggaagttttggtagctgggactactatggaactgtggttctgctgttactgctgttgcatgctgttactgctacttttacccgacctccttgttacaccgtatcaaaaggaaaacaagaagctagactagcctacggatcacatgatcctgtctatcttcaatttgttttactggccttgctttcttgtcagcttgtgtccttcccggtgcttcttccttccgagagcttgggggtaaccctggcattttgccttctgaacatgagtttcaccatttttgcttggtctgctggggatattgcttccttccaaagcttgttatgctggggattcttgttgtaaccctctgccttctgatgggttactgcaaccaaaaaaaacaaaacaaacgaaatttcttgcctagattgtactaggaagatttgtgagagagatattatgtctatgcaagcgggaccacttgggtcgagaataaattagacatccttttgagtaaggattgaattcaatatcctattcgagggcggatagagccaagtatatcctattcgagggcggatagagccaagtatatcctatttgagggcggatagaaccaagtatatcctattcgagggcggatagaaccaagtatatcctattcgagggcggatagaaccaagtatatcctattctagggcggatagagccaagtatatcctattcgagggcggatagagccaagtatatcctattctagggcggatagagccaagtatatcctattctagggcagatagagccaagtatatcctattctagggcggatagagccaaatatatcctattcgaaggtggacaacctataatatcctattcaaaggtggacaacctatagtatcatattcgaaggtgataaacctataatatcctattcgaaggtggacaacctgtaatatcctattcgaaggtggacgaacctataatatcctattcgaaggtggacgaacctataattatcctgttcgaaggcggacaaacctataatatcctattcgaaggtggatgaacctataatatcctattcgaaggtggatgaacctataatatcctattcgaaggcggagaacctatatatcctatttgaaggcggacaacctatatatcctattcgaaggcggacaacctataatatcctattcgaaggcggacaacctataatatcctattcgaaggtggacaacctataatatcctattcgaaggtggacaaacctataatatcctattcgaaggcggagaacctatatatcctattcgaaggcggatgaacctatgaatatccaattcgaaggtggacgaacctataatatcctattcgaaggtggacaacctataatatcctattcgaaggtggacaacctatatatcctattcgagggcggatagagccaaatatatcctattcgagggtggacaaacctataatatcctattcaaaggtggacaaacctataatatcctattcgaaggtggatgaacctataatatcctattcgaaggtggacaaacctataatatcctattcgaaggcggatgaacctataattatcctattcgaaggtggatgaagccaagtatatcctattcgagggcggatagagccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaaccaagtatatcctattcgagggcggatagaaccaagtatatcctattctagggcggatagagccaagtatatcctattctagggcggatagagccaagtatatcctattcgagggcggatagagccaagtatatcctattcgagggcggatagaaccaagtatatcctattcgagggcggatagaaccaagtatatcctattcgagggcggatagaaccaagtatatcctattctagggcggatagagccaagtatatcctattctagggcggatagagccaaatatatcctattcgagggcggatagagccatcataatatcctattcgaaggtggacaacctatattcaaaaattgaaatttaaagagtaaaatgtgtacctctattatacgggcgggctcccgacttcaaaacttgcaattatcttacctcgactatgttttcttaaaattgtgctgtcttgctatcccttaaaacttgaattgatttcctcattccttcgagaaaattttcgacaatggcagaaaattttctgccccagttttggtgcttttccttgtggcatgtctttccgccgttaataagatttccttttcctgcttcaaatcaaagaaaaattgttagattaaaacatggtgagtggtcatgccactcctgctggggatggtttttccctttccccttttcctgctctgagttcccaaaacttgttggggaataatgtttatttgccggggatgacattcctgctggggatgatttttccctttcttccgtccccactttgcatttgtccgaccacctcagcatctgtcggagttgttcctgcatcttgaaaatctgctgaggatcttttttggagtttggtccacaattttctcaactgttgttttatcagtttttctccaacttccccggaaactttagaccaatttcatcatttggtcttgcaacaaacatcttttcattttattgccttatctttggcctgtcctcctatcaatttgctttgtaccatctcggcaactggtagtaagctctgaaaaatctttctcaaaaacaaatctctgaaaaaaaaacttttaaacaaagaaatggaaagatagaaaaagagaaaatctttctgaacaaatgcgggggaaaagaaaagaaaggaacttatctggggtggtataaccaatcccaatgatcatgtcatgcaatccggattcaaccaacccagtctatttatcaatcaatctttctgatggtttcattttgctggggataaacaggtatccaactctttgccaaacgtggatcctttcttccaatctatcttgtcgcctcatagtgcccttcgaagggttttcactaatgagactctctcatttctctcaactcccgtcaccttatggtgcccgtgaaggttttcaccacaagactctctcatttttgccttctctcagctttcggcgccttatagtgcctgtgaaggttttcaccgataagactctctcatttttgctttctctcagctgacgattggagtgttactgataagattctctactggggaattctttggctatcaactccattggggattcccgctagcacttccttagctcatgatcctcattcagtcgggaatcagtgtgttattctcggcttttatttgcctgacttggtacctctcggatactgatcgggaggtcttttttggatatcaatgtgggttttatatagggttttgaaagaaaagaaaataaaattcaaaataactttgatgggtaaaacattacaactcttggaatcaaccctttttcaaaatttaacaacataacttctgccccagttttcttgtttgggggatttttatttttcgtgacactttgtcacgttgcgaccgagccgtgaggcgcctacgtatcctctttgaggaatcaggtcgaacgtagttcactcgattcctttatttttcttgtgattttttttttgttttcgttatcatttttcttctttttctcttttcatttttttttttaacgattccaagaaaggggtatgaaagaatagatacggctcaaaggggaaacaaaggtcaaagtgtttggatagaagaaagaattgcctccgtcatttcattatccgataaatgccaagtacaaataaacaaaacaatgataaatacaaatcaagaagtatacacatagcatctcttgactgcgtctgaattgatagccatgttagtgcatcttccctcgatatctgttaagcataaagcgccattggataatactttggtcacaataaatggtcctttccaattttgggcgaacttgccctttgccttgacctaatgcgggaggatccgtacattgtccacatcctccagattgacagtttcagtgtcattctagttggacttggattcttcttcgtactggcttagtttcctgtttacctcttcaaacactttatcctcatcatattccgattcactatcacagtcgatctcttgtataattaactcggaattagattgattatttagactgggccgaaaatccgtcatgcatgccatatcattagaaccagtaaagagaaaactgttcagaaagaaagaaaacaaacaaaaataaaatagaaacaaggatagaaaaacttttgctttaataaaacatgggataacagggttcacacaagacagaatttggattacaccctggaataatccagaaaaaatgagaaaggtaaatcaaagcttgctaccaagactccctccaagtaggaagaggagtagttgtccaattgttgataatggccctaggccccataaactgtgtatctgccttactggaaccctctccagtttctatcttgttgatgtcggcaaataacctttcaaaccttgattcaagtccccatttggcctgacatcccccttctccatctgtacccctgcttcctcacttatcgatttttctttctgagtggcacggatcatcatttactgtctgtgagggtttctttggctcccctccttcgtgcactagttcgatcatgtgggcctcatggtgtgccggtaacgggttttgattaatgttaggtgcctccggtgtctgaacctcaatcttcttggtatcaataagattctgcactgcatgtttcaacttccaacacttctcggtatcatgtccgggggcccccgaacaatattcacagcttaccgagtggtccatatttttgggaagggggttaggcaatctgggttcaacaggactcaacaagcctaactaccttaatttgtgaaacaaaacagtataggtttctcccaactcagtgaatgttctctgattcccacggaaacctggccctgtagggttcctgtatgcccttggtggtggataagtatttcgtggagctggtgcgcgccattgcggttgggacggaggttggttatacgcctgtgcctgatggacagaaaaatgtggttctggtggcggatagtaatgttgtggtgggttgtgagggtaatttgggtgatggggtctaggttggtagtagggtgaaggacctctagatctggacccagtacctgcttcgactgttgcgacttctccccccttcttcttcccgagcacgcctcccgtgccgctctgaatggcttgggtagttgcctttatcgcggaataactcacgattttgttggtcttcaacccttcttctaccatgctccccatcttgacaacttcattgaatgttttgccgacggctgacaccaaatggaaataataagtggactctaaagcttgcaaaaaatagtccaccatttcaccttctttcataggtggatctaccctggcggcctgctctctccatctgaacccatattccttaaagctctctccaggcttcttctcgagctttgtcaaggagagtcggtcgggcacaatctccaaattgtactgaaagtgactagcaaaggcctgggctaagtcgtcccaggtataccaacgggtgtggtcttgcttagtataccattccaaggctgacccactgagactccggctgaagtatgccattagtagttcgtcttttccaccagcacccctcatatcgctacaaaaccccctcaaatgggcaatggggtcaccatgaccattataaagatcaaatttcggtagtttgaaacccaccggcaattggacctctggaaacaaacataggtctttgtaagcaatactcacccgtcctccaagaccttgcatatttcggagcgactgttctatgcttttcactttgcgctccttttcctcttgctcgggatttttaagaggtttttcttctccagatatatccataagagggggataataatatggctcatggggtctgaaagtgggctcagggggatagtattggttttctggggtgtgaaacaaaggctcatttgccgatttgtgtaacatggcgggtgcaggagccacgtatacaggagcaatcggtggtggtggtggtgggatttgctttggtggtggagtttggggattgtgaacagattccccctgatggtactgatgtattgggtaacttgttgatggatcaagggaaggatgttccgaattttgagctgatgggaggggaggagcattgggaagcattggtaatggctgtcctttagcccaggccagatgcatctctgctatctgtctccttaacatgtccacttcttctttcattgcatgtatttccgtcttttcttcttcagtacttttgtcggaattagacatgcttttgggaacaggcccttttgatctggtatggtatcggtaatctgccagaacgccttaactaactgtttgaaaactggtaaacaacaaacttgttagttttcaaatttcaacagataggttatggcacattgggatgcaaatgctcctaggcagtttaaccattcttatgatgcttttgctcagactgcatgcgtcatcccagcttattattttcaagtgtctctaagtccctccattatttccctcacttcttttatttattttccctttttactataagtagtggtcgaatcttatgtaggttgcctacgtatcatgtccccgcatgaatcagaccctagcgtagttcgtgcaaatgaaagataaacaatgataaaatatttttggaattttccatctttataaaaacaaactgtgtttcaaaagtttaaagatgatctacaaactcgaaaatcaaacaactcacatattctaattaaaagatttacaaactcaaaaacaaatggccagcttcctttccgcgtttgccaaattcaacccaatggctattttgcaaacatggccctttcacatgaatgttgaggccaaggagattattttatgacatttcacaaacacgttcgttcttttacgaaaatagcctaaaaaattggaagatatcctaaggctatctcgacaagaacggtttaatacattaccgaagctggcttgacttattctgaccaaaattcaaatggcattcacttgccaaatgactctctttttttccttttttttcaaattaaaataaaagacctggtatcgcaaatacggcctttcagcgcctcggggacgaagattttaaggctgtgtgggtcaactggccaaaatctaaaaatgacccaaaggtggctgtttatgcaaagtcagccttctgactcccctttcgggaacattcggctatttttgacaaaaacagcatcacctgacttatttatgacgaagatttaaatttttttgattttttggctatattagcaaaaggggaggttggacccgatgcgggttgcctacgtatcccacaccctgtgagaatcaaaacggcgtagttcgccaaaatgaaactggcttaaaggccttttgtttaaaacattttccaaaattttgacagcattttgacactacttggttttttgaaaaattggtagttatctataccctgtcatttctctctcttctaatatcgtaagccggtcagcatgcaagtcggaacaattaatgcataactcaaacaagatgcagtaggatggtctttcattgtttcaggttgctattcctagacggactcaacccctgtgttgagccccctaagtcaaatgcaacgtgatgcaaataagcgttgtcctactagggatccggcatgaggatatgttatactaggttcagactcgggtgttgttctagacctggcttacccgagcggacagctcgagccgagaaaggtcagtattgctggtagcagcgctttccgacttaactgaccacgttccccgcctaacttgtgtgacaaaatccttcaccggatgcgaagcaccacggctatctcaaagaagcgggctatgacaagcaaatgcccaattttcatttccagaagactcagagagaagggggtttcgcaacagtttatatacagttcagataatatcaaagcggtaacaaaacatcatttcacatactaagcgcacatcatataaaaatatcagataataaacaagccaaagacaacaattatttcaagctcgaattcttaaaccctgaaccggtggttctgggacaaacatccccagcagagtcgccagagctgtcgcacctcctttttacgcatccgcgagggcgcaagggagtttttccaattaaaggacaatcgaaacgggatttattattaaagattcagagtcgccacttgggagattaagggtgtcccaagtcaccagttttaatcccgaatcgaggaaaagaatgactctgtttaacagtttgcgtaccagaaatctggataaggaattttgttaacccgggagaaggtgttaggcattcccgagttccgtggttctagcacggtcgctcaactgtcatattcggcttaattatctgattttttacaattatgaacttatatgcaaattttaacttttaaccgcttttattattatttatttatttaaaagaattacaacgtcatgagaatatatctcgaactgcatcacataaatgtatccgcaatttttaatatattccgacttcgttgagatttggatttgggtcacataaatgtatacccgagtttagggaagataacatcattaaacacgcgcctaaagatgctaccgcgttattattttgagaaaagccgtgaaattcgctatacgacttgtctcgaaatctaagcaatgcttattgagggccccgcaatttgtacattttattcgacgaggctcatctcgtttattttaaggatatcctaaagtgactacattttctattaatggcgtctctaaaagtaatgagaaagtcctaattaattacatgcttaaaaatataacatattaattgttagacgaagacaaatattaacggaaagaaaataaaataaaataaatagaaattcgaaattaaaataaaataaaaacaaaaatttcgaaatttataaataaattacgaaattcgataactaatattcgaaagaaattgattatagctagattaaaactcacataattacgtaaaactgttgaaattaaatattcacaattatttgcaactaaatttaaccataattactagagcttattagaaagctattaaacttaaacattaactcggcttgcttgaactcaaatcattccttaatgcctaattcacgaaattaattcaaattaaaaccttaaaaagatttagctacatgttcgcgattaacctactattgacaacatcaaaacctacacaattagtgaattgaacagcttgaccaagccgattcaataaagatcaactcatactatttcttcttattccaattattaaacagtttgacagtaatgaacatgcttgaacatatattacctactaaccaaattaaaacagaatattatttaatacatcactacaagctgtcaagtcatacgaacatggcagaaacttatataacaatagtatatagcttggcctaaatacattaaataacaaaactaaataaaattaaaacttcaactcttcatttgtattcatgcttcatgttatcaacttacaaggtgtatcagttgtgtacctggttttggaatacaagaagaggaagatcagtagtgcagcaatagcacaacacagcaacaacaattcagcaacaagtggaacaatagcagaacccagtaccagattgaaaaccaaacagaatgacccaaacaacagaaaaaccacagcaaccagatgtgaaccgggaaaacaccaaaataaataacaccaggcagaaatagaaagaaccaaaagcaagagatgcaatggaacaattctgattttttatcttttaacactcaaaatataacactttaactgaattccaagattttaaaagtcagttaaatttttactctctaaactctgaatttttgatgtcaaaatccagcctaacacttaacagccttcactctctattttttctctgaacatttttcaatctctcttttttcagattttcagattgttctcctcttttcagattattctcctcctttcagattattctctcttttcaaatttcagattctctttttcttccttaatgttctcctcccttaactctctgttttcaaccctttttataacaagtaacagaccgttctgaacacttaatcaaagaaaatttctgctcaccaactcccactaagctattttgtcatttaaaaaaactaatctacctcctacccacagtagtaacccctaaattaccccctagccacttagcagcccctagattacccctaatcagctataaccaaactcctaatcaccattcaaacagtgacctaattaaatcaggcaattaacagttagagaaatataaacaatcagaatgccaaatgattcaaatatatacgcaaacgacctaatcgatgaagcataatcaactgattacaaacaatcagaaaaaaaaacagataagcatgtgattcggatgattttgaacagaacatggagctaatatagaactgattaatcgacgacctttaacgaatcgattacacataacaactagcaacgaacaagaaacaatcagaaacaaaaaattcacatggttttcggcctaaactggggaaacatgaaactaatttttcgacgatgttaaatcgaatcgattaagtagttcacaaccaacccctactaataataatcagcaacgacgagtcgaccaaataaaaaggtcccaggcagaagaagagaagaagaagcaatgaaattaaacgagattataactaaaatttaaacaaataacagtaacagaaaatagaacaaaggcaaggaacgaaataccttgagaaatcagaaaacttggatggacccaggtcgaacggactcgagttctttgaggtcgaacagaccttagccaaggtgttctcaattgagaacaccttaactaaagtcaattaaaccccaaatcttcaactacttcggacaaaccccaagctttggagttctagggttcatgcggccaatttggggttcgaccctttcaagttagattcgaactaaaccaagggtggtttggtgactagggaggtcagggggtgccatggcatgaatttggggccggttgggatagtttgaggtttggctcgaatcttagattgaagattcgagcaagctggggatgattcgaaggataaggagcggggattcggaaagaggagggcgagggggatcaggggtgttaatttgggtatgtttggccaccgtccgccgccgtgaggcgatttccggtgggcggagctcggcggtttggggcggagctacagggagggtctctgaggttagagagatgaatgagagagaaggaggggtgtgtggaaatgagaggggtaggggatttgagggtttgtgtaattaaaattggttcaataaatcggggccgttggatcaaggatgatcaacggccctgatcatttctctcatttaaaacggggtcgtttagattagtggggaggtgggtcggtccgggtccaggtgggtcgggtagacgggtggtgatgtggaccgttagatcacacatttggacggctgagatcatcgttacaaaaacgatgccgtatgggtgcaagctcaattgagctgacctgggtcggccctgggttgtatatattgggcctgatttcatttaaaatatagccattttccttctttcttccaattttaattaagctagcctcttttcacatatagccacattggctttacacaattttgtgcaactttgcacacattaatcaaatataaaaatgaaaactattaaacatttaacacacaaaattaacatacattacgcatttaaatnnnnnnnnnntgtggaaatgagaggggtaggggatttgagggtttgggtaattaaaattggttcaataaatcggggccgttggatcaaggatgatcaacggccctgatcatttctctcatttaaaacggggtcgtttagattagtggggaggtgggtcggtccgggtccaggtgggtcgggtagacgggtggtgatgtggaccgttagatcacacatttggacggctgagatcatcgttacaaaaacgatgccgtatgggtgcaagctcaattgagctgacctgggtcggccctgggttgtatatattgggcctgatttcatttaaaatatagccattttccttctttcttccaattttaattaagctagcctcttttcacatatagccacattggctttatacaattttgtgcaactttgcacacattaatcaaatataaaaatgaaaactattaaacatttaacacacaaaattaacatacattacgcatttaaataacacaaattgcacatttagacacaattgcacaaagaccgcacactttcgcgaattcctttcgatctacttgtgatcaattaattctgaaagcacactattagcttctaatgcatgtgacacatatttttgtattttttaattaattttaacaaataaacacgcacagacaaatgcaaacgctaaagaaaagataacacaaaaatccataaaaatcacacacaacacaaaactattttttttttgaatttttgggagtaattgtcgcgagagcaaaaatcacgtgctcacagctgcccctctttgtccgaaaacacaaagagctttgtgttttcgtgcaaagataaagtgagcggatacgagcgatttttgcccgttggaatactccgtgtgaagcatttttttttaaaaaagatttaaccgaacctttgcttcaaaggcttcctacatatccctggctaaaagggaatcaggttaatgtagttcgggaagttttggtagctgggactactatggaactgtggttctgctgttactgctgttgcatgctgttactgctacttttacccgacctccttgttacaccgtatcaaaaggaaaacaagaagctagactagcctacggatcacatgatcctgtctatcttcaatttgttttactggccttgctttcttgtcagcttgtgtccttcccggtgcttcttccttccgagagcttgggggtaaccctggcattttgccttctgaacatgagtttcaccatttttgcttggtctgctggggatattgcttccttccaaagcttgttatgctggggattcttgttgtaaccctctgccttctgatgggttactgcaaccaaaaaaaacaaaacaaacgaaatttcttgcctagattgtactaggaagatttgtgagagagatattatgtctatgcaagcgggaccacttgggtcgagaataaattagacatccttttgagtaaggattgaattcaatatcctattcgagggcggatagagccaagtatatcctattcgagggcggatagagccaagtatatcctattcgagggcggatagaaccaagtatatcctattcgagggcggatagagccaagtatatcctattcgagggcggatagagccaagtatatcctattctagggcggatagagccaagtatatcctattctagggcagatagagccaagtatatcctattctagggcggatagagccaaatatatcctattcgaaggtggacaacctataatatcctattcaaaggtggacaacctatagtatcatattcgaaggtgataaacctataatatcctattcgaaggtggacaacctgtaatatcctattcgaaggtggacgaacctataatatcctattcgaaggtggacgaacctataattatcctgttcgaaggcggacaaacctataatatcctattcgaaggtggatgaacctataatatcctattcgaaggtggatgaacctataatatcctattcgaaggcggagaacctatatatcctatttgaaggcggacaacctatatatcctattcgaaggcggacaacctataatatcctattcgaaggcggacaacctataatatcctattcgaaggtggacaacctataatatcctattcgaaggtggacaaacctataatatcctattcgaaggcggagaacctatatatcctattcgaaggcggatgaacctatgaatatccaattcgaaggtggacgaacctataatatcctattcgaaggtggacaacctataatatcctattcgaaggtggacaacctatatatcctattcgagggcggatagagccaaatatatcctattcgagggtggacaaacctataatatcctattcaaaggtggacaaacctataatatcctattcgaaggtggatgaacctataatatcctattcgaaggtggacaaacctataatatcctattcgaaggcggatgaacctataattatcctattcgaaggtggatgaagccaagtatatcctattcgagggcggatagagccaaatatatcctattcgagggcggatagagccacgtatatcctattcgagggcggatagaaccaaatatatcctattctagggcggatagagccaagtatatcctattcgagggcggatagagccaagtatatcctattcgagggcggatagagccaagtatatcctattctagggcggatagagccaaatatatcctattcgagggcggatagagccaagtatatcctattcgagggcggatagagccaaatatatcctattcgaaggtgtacaaacctataatatcctattcgaaggtggatgaacctataatatcctattcgaaggtggatgaacctataatatcctattcgaaggtggatgaacctataatatcctattcgaaggtggatgaacctataatatcctattcgaaggcggagaacctatatatactattcgaaggtggacaaacctataatatcctattcgaaggcggagaacctatatatcctattcgagggcggatagagccaaatatatcctattcgagggtggacaaacctataatatcctattcgaaggtggatgaacctataatatcctattcgaaggtggatgaacctataatatcctattcgaaggcggagaacctatatatcctattcgaaggcggacaacctatatatcctattcgaaggcggacaacctataatatcctattcgaaggcggacaacctataatatcctattcgaaggtggacaacctataatatcctattcgaaggtggacaaacctataatatcctattcgaaggcggagaacctatatatcctattcgaaggcggatgaacctatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaattcgaaggtggacgaacctataatatcctattcgaaggtggacaacctataatatcctattcgaaggtggacaacctatatatcctattcgagggcggatagagccaaatatatcctattcgagggtggacaaacctataatatcctattcaaaggtggacaaacctataatatcctattcgaaggtggatgaacctataatatcctattcgaaggtggacaaacctataatatcctattcgaaggcggatgaacctataattatcctattcgaaggtggatgaagccaagtatatcctattcgagggcggatagagccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaaccaagtatatcctattcgagggcggatagaaccaagtatatcctattctagggcggatagagccaagtatatcctattctagggcggatagagccaagtatatcctattcgagggcggatagagccaagtatatcctattcgagggcggatagaaccaagtatatcctattcgagggcggatagaaccaagtatatcctattcgagggcggatagaaccaagtatatcctattctagggcggatagagccaagtatatcctattctagggcggatagagccaaatatatcctattcgagggcggatagagccatcataatatcctattcgaaggtggacaacctatattcaaaaattgaaatttaaagagtaaaatgtgtacctctattatacgggcgggctcccgacttcaaaacttgcaattatcttacctcgactatgttttcttaaaattgtgctgtcttgctatcccttaaaacttgaattgatttcctcattccttcgagaaaattttcgacaatggcagaaaattttctgccccagttttggtgcttttccttgtggcatgtctttccgccgttaataagatttccttttcctgcttcaaatcaaagaaaaattgttagattaaaacatggtgagtggtcatgccactcctgctggggatggtttttccctttccccttttcctgctctgagttcccaaaacttgttggggaataatgtttatttgccggggatgacattcctgctggggatgatttttccctttcttccgtccccactttgcatttgtccgaccacctcagcatctgtcggagttgttcctgcatcttgaaaatctgctgaggatcttttttggagtttggtccacaattttctcaactgttgttttatcagtttttctccaacttccccggaaactttagaccaatttcatcatttggtcttgcaacaaacatcttttcattttattgccttatctttggcctgtcctcctatcaatttgctttgtaccatctcggcaactggtagtaagctctgaaaaatctttctcaaaaacaaatctctgaaaaaaaaacttttaaacaaagaaatggaaagatagaaaaagagaaaatctttctgaacaaatgcgggggaaaagaaaagaaaggaacttatctggggtggtataaccaatcccaatgatcatgtcatgcaatccggattcaaccaacccagtctatttatcaatcaatctttctgatggtttcattttgctggggataaacaggtatccaactctttgccaaacgtggatcctttcttccaatctatcttgtcgcctcatagtgcccttcgaagggttttcactaatgagactctctcatttctctcaactcccgtcaccttatggtgcccgtgaaggttttcaccacaagactctctcatttttgccttctctcagctttcggcgccttatagtgcctgtgaaggttttcaccgataagactctctcatttttgctttctctcagctgacgattggagtgttactgataagattctctactggggaattctttggctatcaactccattggggattcccgctagcacttccttagctcatgatcctcattcagtcgggaatcagtgtgttattctcggcttttatttgcctgacttggtacctctcggatactgatcgggaggtcttttttggatatcaatgtgggttttatatagggttttgaaagaaaagaaaataaaattcaaaataactttgatgggtaaaacattacaactcttggaatcaaccctttttcaaaatttaacaacataacttctgccccagttttcttgtttgggggatttttatttttcgtgacactttgtcacgttgcgaccgagccgtgaggcgcctacgtatcctctttgaggaatcaggtcgaacgtagttcactcgattcctttatttttcttgtgattttttttttgttttcgttatcatttttcttctttttctcttttcatttttttttttaacgattccaagaaaggggtatgaaagaatagatacggctcaaaggggaaacaaaggtcaaagtgtttggatagaagaaagaattgcctccgtcatttcattatccgataaatgccaagtacaaataaacaaaacaatgataaatacaaatcaagaagtatacacatagcatctcttgactgcgtctgaattgatagccatgttagtgcatcttccctcgatatctgttaagcataaagcgccattggataatactttggtcacaataaatggtcctttccaattttgggcgaacttgccctttgccttgacctaatgcgggaggatccgtacattgtccacatcctccagattgacagtttcagtgtcattctagttggacttggattcttcttcgtactggcttagtttcctgtttacctcttcaaacactttatcctcatcatattccgattcactatcacagtcgatctcttgtataattaactcggaattagattgattatttagactgggccgaaaatccgtcatgcatgccatatcattagaaccagtaaagagaaaactgttcagaaagaaagaaaacaaacaaaaataaaatagaaacaaggatagaaaaacttttgctttaataaaacatgggataacagggttcacacaagacagaatttggattacaccctggaataatccagaaaaaatgagaaaggtaaatcaaagcttgctaccaagactccctccaagtaggaagaggagtagttgtccaattgttgataatggccctaggccccataaactgtgtatctgccttactggaaccctctccagtttctatcttgttgatgtcggcaaataacctttcaaaccttgattcaagtccccatttggcctgacatcccccttctccatctgtacccctgcttcctcacttatcgatttttctttctgagtggcacggatcatcatttactgtctgtgagggtttctttggctcccctccttcgtgcactagttcgatcatgtgggcctcatggtgtgccggtaacgggttttgattaatgttaggtgcctccggtgtctgaacctcaatcttcttggtatcaataagattctgcactgcatgtttcaacttccaacacttctcggtatcatgtccgggggcccccgaacaatattcacagcttaccgagtggtccatatttttgggaagggggttaggcaatctgggttcaacaggactcaacaagcctaactaccttaatttgtgaaacaaaacagtataggtttctcccaactcagtgaatgttctctgattcccacggaaacctggccctgtagggttcctgtatgcccttggtggtggataagtatttcgtggagctggtgcgcgccattgcggttgggacggaggttggttatacgcctgtgcctgatggacagaaaaatgtggttctggtggcggatagtaatgttgtggtgggttgtgagggtaatttgggtgatggggtctaggttggtagtagggtgaaggacctctagatctggacccagtacctgcttcgactgttgcgacttctccccccttcttcttcccgagcacgcctcccgtgccgctctgaatggcttgggtagttgcctttatcgcggaataactcacgattttgttggtcttcaacccttcttctaccatgctccccatcttgacaacttcattgaatgttttgccgacggctgacaccaaatggaaataataagtggactctaaagcttgcaaaaaatagtccaccatttcaccttctttcataggtggatctaccctggcggcctgctctctccatctgaacccatattccttaaagctctctccaggcttcttctcgagctttgtcaaggagagtcggtcgggcacaatctccaaattgtactgaaagtgactagcaaaggcctgggctaagtcgtcccaggtataccaacgggtgtggtcttgcttagtataccattccaaggctgacccactgagactccggctgaagtatgccattagtagttcgtcttttccaccagcacccctcatatcgctacaaaaccctctcaaatgggcaatggggtcaccatgaccattataaagatcaaatttcggtagtttgaaacccaccggcaattggacctctggaaacaaacataggtctttgtaagcaatactcacccgtcctccaagaccttgcatatttcagagcgactgttctatgcttttcactttgcgctccatttcctcttgctcaggatttttaagaggtttttcttctccagatatatccataagagggggataatgatatggctcatggggtctgaaagtgggctcagggggatagtattggttttctggggtgtgaaacaaaggctcatttgccgatttgtgtaacatggcgggtgcaggagccacgtatacaggagcaatcggtggtggtggtggtgggatttgctttggtggtggagtttggggattgtgaacagattccccctgatggtactgatgtattgggtaacttgttgatggatcaagggaaggatgttccgaattttgagctgatgggaggggaggagcattgggaagcattggtaatggctgtcctttagcccaggccagatgcatctctgctatctgtctccttaacatgtccacttcttctttcattgcatgtatttccgtcttttcttcttcagtacttttgtcggaattagacatgcttttgggaacaggcccttttgatctggtatggtatcggtaatctgccagaacgccttaactaactgtttgaaaactggtaaacaacaaacttgttagttttcaaatttcaacagataggttatggcacattgggatgcaaatgctcctaggcagtttaaccattcttatgatgcttttgctcagactgcatgcgtcatcccagcttattattttcaagtgtctctaagtccctccattatttccctcacttcttttatttattttccctttttactataagtagtggtcgaatcttatgtaggttgcctacgtatcatgtccccgcatgaatcagaccctagcgtagttcgtgcaaatgaaagataaacaatgataaaatatttttggaattttccatctttataaaaacaaactgtgtttcaaaagtttaaagatgatctacaaactcgaaaatcaaacaactcacatattctaattaaaagatttacaaactcaaaaacaaatggccagcttcctttccgcgtttgccaaattcaacccaatggctattttgcaaacatggccctttcacatgaatgttgaggccaaggagattattttatgacatttcacaaacacgttcgttcttttacgaaaatagcctaaaaaattggaagatatcctaaggctatctcgacaagaacggtttaatacattaccgaagctggcttgacttattctgaccaaaattcaaatggcattcacttgccaaatgactctctttttttccttttttttcaaattaaaataaaagacctggtatcgcaaatacggcctttcagcgcctcggggacgaagattttaaggctgtgtgggtcaactggccaaaatctaaaaatgacccaaaggtggctgtttatgcaaagtcagccttctgactcccctttcgggaacattcggctatttttgacaaaaacagcatcacctgacttatttatgacgaagatttaaatttttttgattttttggctatattagcaaaaggggaggttggacccgatgcgggttgcctacgtatcccacaccctgtgagaatcaaaacggcgtagttcgccaaaatgaaactggcttaaaggccttttgtttaaaacattttccaaaattttgacagcattttgacactacttggttttttgaaaaattggtagttatctataccctgtcatttctctctcttctaatatcgtaagccggtcagcatgcaagtcggaacaattaatgcataactcaaacaagatgcagtaggatggtctttcattgtttcaggttgctattcctagacggactcaacccctgtgttgagccccctaagtcaaatgcaacgtgatgcaaataagcgttgtcctactagggatccggcatgaggatatgttatactaggttcagactcgggtgttgttctagacctggcttacccgagcggacagctcgagccgagaaaggtcagtattgctggtagcagcgctttccgacttaactgaccacgttccccgcctaacttgtgtgacaaaatccttcaccggatgcgaagcaccacggctatctcaaagaagcgggctatgacaagcaaatgcccaattttcatttccagaagactcagagagaagggggtttcgcaacagtttatatacagttcagataatatcaaagcggtaacaaaacatcatttcacatactaagcgcacatcatataaaaatatcagataataaacaagccaaagacaacaattatttcaagctcgaattcttaaaccctgaaccggtggttctgggacaaacatccccagcagagtcgccagagctgtcgcacctcctttttacgcatccgcgagggcgcaagggagtttttccaattaaaggacaatcgaaacgggatttattattaaagattcagagtcgccacttgggagattaagggtgtcccaagtcaccagttttaatcccgaatcgaggaaaagaatgactctgtttaacagtttgcgtaccagaaatctggataaggaattttgttaacccgggagaaggtgttaggcattcccgagttccgtggttctagcacggtcgctcaactgtcatattcggcttaattatctgattttttacaattatgaacttatatgcaaattttaacttttaaccgcttttattattatttatttatttaaaagaattacaacgtcatgagaatatatctcgaactgcatcacataaatgtatccgcaatttttaatatattccgacttcgttgagatttggatttgggtcacataaatgtatacccgagtttagggaagataacatcattaaacacgcgcctaaagatgctaccgcgttattattttgagaaaagccgtgaaattcgctatacgacttgtctcgaaatctaagcaatgcttattgagggccccgcaatttgtacattttattcgacgaggctcatctcgtttattttaaggatatcctaaagtgactacattttctattaatggcgtctctaaaagtaatgagaaagtcctaattaattacatgcttaaaaatataacatattaattgttagacgaagacaaatattaacggaaagaaaataaaataaaataaatagaaattcgaaattaaaataaaataaaaacaaaaatttcgaaatttataaataaattacgaaattcgataactaatattcgaaagaaattgattatagctagattaaaactcacataattacgtaaaactgttgaaattaaatattcacaattatttgcaactaaatttaaccataattactagagcttattagaaagctattaaacttaaacattaactcggcttgcttgaactcaaatcattccttaatgcctaattcacgaaattaattcaaattaaaaccttaaaaagatttagctacatgttcgcgattaacctactattgacaacatcaaaacctacacaattagtgaattgaacagcttgaccaagccgattcaataaagatcaactcatactatttcttcttattccaattattaaacagtttgacagtaatgaacatgcttgaacatatattacctactaaccaaattaaaacagaatattatttaatacatcactacaagctgtcaagtcatacgaacatggcagaaacttatataacaatagtatatagcttggcctaaatacattaaataacaaaactaaataaaattaaaacttcaactcttcatttgtattcatgcttcatgttatcaacttacaaggtgtatcagttgtgtacctggttttggaatacaagaagaggaagatcagtagtgcagcaatagcacaacacagcaacaacaattcagcaacaagtggaacaatagcagaacccagtaccagattgaaaaccaaacagaatgacccaaacaacagaaaaaccacagcaaccagatgtgaaccgggaaaacaccaaaataaataacaccaggcagaaatagaaagaaccaaaagcaagagatgcaatggaacaattctgattttttatcttttaacactcaaaatataacactttaactgaattccaagattttaaaagtcagttaaatttttactctctaaactctgaatttttgatgtcaaaatccagcctaacacttaacagccttcactctctattttttctctgaacatttttcaatctctcttttttcagattttcagattgttctcctcttttcagattattctcctcctttcagattattctctcttttcaaatttcagattctctttttcttccttaatgttctcctcccttaactctctgttttcaaccctttttataacaagtaacagaccgttctgaacacttaatcaaagaaaatttctgctcaccaactcccactaagctattttgtcatttaaaaaaactaatctacctcctacccacagtagtaacccctaaattaccccctagccacttagcagcccctagattacccctaatcagctataaccaaactcctaatcaccattcaaacagtgacctaattaaatcaggcaattaacagttagagaaatataaacaatcagaatgccaaatgattcaaatatatacgcaaacgacctaatcgatgaagcataatcaactgattacaaacaatcagaaaaaaaaacagataagcatgtgattcggatgattttgaacagaacatggagctaatatagaactgattaatcgacgacctttaacgaatcgattacacataacaactagcaacgaacaagaaacaatcagaaacaaaaaattcacatggttttcggcctaaactggggaaacatgaaactaatttttcgacgatgttaaatcgaatcgattaagtagttcacaaccaacccctactaataataatcagcaacgacgagtcgaccaaataaaaaggtcccaggcagaagaagagaagaagaagcaatgaaattaaacgagattataactaaaatttaaacaaataacagtaacagaaaatagaacaaaggcaaggaacgaaataccttgagaaatcagaaaacttggatggacccaggtcgaacggactcgagttctttgaggtcgaacagaccttagccaaggtgttctcaattgagaacaccttaactaaagtcaattaaaccccaaatcttcaactacttcggacaaaccccaagctttggagttctagggttcatgcggccaatttggggttcgaccctttcaagttagattcgaactaaaccaagggtggtttggtgactagggaggtcagggggtgccatggcatgaatttggggccggttgggatagtttgaggtttggctcgaatcttagattgaagattcgagcaagctggggatgattcgaaggataaggagcggggattcggaaagaggagggcgagggggatcaggggtgttaatttgggtatgtttggccaccgtccgccgccgtgaggcgattttcggtgggcggagctcggcggtttagggcggagctacagggagggtctctgaggttagagagatgaatgagagagaaggaggggtgtgtggaaatgagaggggtaggtgatttgagggtttgggtaattaaaattggttcaataaatcggggccgttggatcaaggatgatcaacggccctgatcatttctctcatttaaaacggggtcgtttagattagtggggaggtgggtcggtccgggtccaggtgggtcgggtagacgggtggtgatgtggaccgttagatcacacatttggacggctgagatcatcgttacaaaaacgatgccgtatgggtgcaagctcaattgagctgacctgggtcggccctgggttgtatatattgggcctgatttcatttaaaatatagccattttccttctttcttccaattttaattaagctagcctcttttcacatatagccacattggctttacacaattttgtgcaactttgcacacattaatcaaatataaaaatgaaaactattaaacatttaacacacaaaattaacatacattacgcatttaaataacacaaattgcacatttagacacaattgcacaaagaccgcacactttcgcgaattcctttcgatctacttgtgatcaattaattccgaaagcacactattagcttctaatgcatgtgacacatatttttgtattttttaattaattttaacaaataaacacgcacagacaaatgcaaacgctaaagaaaagataacacaaaaatccataaaaatcacacacaacacaaaactattttgtttttgaatttttgggagtaattgtcgcgagagcaaaaatcacgtgctcacaactagcagctcctgaatgttcatatcaatggccaatttaagccccaagatgcaggcttcatactcggccatattgttggtgcatggaaatctgagtttggcggataccgggtaatgctgaccggtttctgataccaaaactgctcctataccgactcctttgaaatttacggccccgtcgaaaaacatcctccagccatcatagggttctgcaatgtcttctcctacgaaggctacttcctcatcgggaaaatacgtcttcaatggctcgtattctcctcctacgggattttcagcgagatgatctgctaaagcttgccctttaactgccttctgggtgacatagacaatgtcgaattcactcaacaggatttgccacttggcgagcttgccagtgggcatgggcttctggaagatatatttcaatggatccatcctcgatatgagataagtagtgtaagcgcagaaatagtgcctcaatttctgagctacccaagtcaaagcacaacaagtgcgttccaacagggaataccgagcctcgtacagggtaaacttcttgctgaggtagtagatagcttgttcttttcttcccgtttcatcgtgctgccccaagacgcaaccaaatgctccatccaagactgcgagataaagaaataaaggcctcccaggctcaggcggaaccaggactggaggcgtagacaagtattccttgattctttcaaaagccttttgacactcatcggtccattaggtggcggcatccttatttagcatcttgaagataggttcgcaaatgatagtagactgagctatgaaccggctgatgtaattgagccttcccagaaaactcatcacatccttcttattttttggcggtggcaactcttgaatagatttgacttttgacggattcagctctattcctcggcgactcacaatgaaacctaataacattccagcaggaaccccgaatgcacacttggcgggattcagtttcaagttatacctccttagtttgttgaagaacttttgcaagtcctccatgtgatctacggctttcctggacttgacgatgacgtcatccacatacacctcgatctctttatgaatcatgtcatggaaaattgtagtcatggccctcatgtaagtagccccagcgttcttcaacccaaacggcatcattctgtagcaatacattccccatggcatgataaacgccattttctctgcatcttcttcatccatccatatctgatggtaccccgcaaaacaatcgacgaacgactgtaactcatgcttggcgcagttgtcgatcaagatatgtatatttggcaaggggaaatcatctttgggactggccctgttgagatcccggtagtcgacacaaactctaacttttccatccttctttggtactggcacaatgttggctaaccaggttggatactctaacacttgaagaactctggccttgacctgcttggtgacctcttctttgattttcaaactcatatctggcttgaactttctaagcatctgctttaccagtggacatgcaggatctgtcggcaacttgtggacgacgatggatgtgctgagaccagtcatatcgtcataagaccatgcaaagatgtcctcatattctcttaaaaactccgtgtattctttcttttctgttggtgataggtgcacactaatgcgcgtctctttgacattctctgcatctccgaaattgacgacctcagtttcatctaagttggaattaggtctattctcaaaattctcgacctctctaacaacctcttctggtatttcatcttcttctgagtctatgtccgtttgttgcatagcctagttgcaagttacagttgtcggttcatcatcaagatatgtaatagtaatgctggaaaataaagtaaataacagagaaagtaatgagtagcgagatatttgataaactggaaaaatgcttttgattaaaactcataaatgttcaaacatcggagctcttttggaacgtaaagacattgcgaaaattaaagaaaaacagctaaaacaaatgtgcatggtgcttgttcagtcttgctaccccgaagatctccgggcaacggtggtcctgattgaccaattggtgaggttctcccctcgattcacaacctgaatggaagggccttcctccccttcttcttcaaaaatcacacagcagtccatgtcctcctctagaaacaggttcttcattgccgcaagagcctcgtcttcctctgaaccatagagagtgtcggctggctgaaatgtctgctccagttaaagtatggggtattccaatgggtaatatgggccgcgccatggtggcaaccactctttgaactctttccaggtgtactcatatcctagtctgaaggtggttccatgcttcttcaactggataggtttagtgatgccctgaagattcttaccaagcccttttcctggttcatacccgctctaattcaaaatgctttcgaccttgttactccaccatttgtccttatccactgcgttgactcgctcaatatgatggtatgtttctccgcctatccttcttctacctccaatcatcgggatagtctggcgactgtatataggattgctaccgtcgccgtggatgatcacttcctgatggttccactcaaacttcacggcctgatgcaaggttgatgccacggccccagcggcgtggatccagggtcgtcccagcaataggttgtaagatgctggtacgtcaatgacttggaaatcaacatcaaaccaagtaggccccatttgcaaacacaggctaatctccccgagggtggacctctgagacccatcgaaagccttaacgttaatagccccatcctttatctcatgcaaacctttgcccaatgttctgagggtgatcaacggacaaatgttgaggctagagcctccatcgactaagattctggtgatgaaatgatcttcacattgcacagtgatgtgcagtgccttgttatgaccgagcccttcaggtggtaattcgtccttgtggaaagtgattttgtgactttccaatacttgccctaccatgtttgccatctctcctcctgttatgttgttcgggacgtaagcctcgctcaatattttcatcaaggcgttcttatgtgcctcggaactctgcagtagtgccaagatggaaatttgcaccggagtcttgtttagttgttcaacaactgaatattccttagcctgtatttttctccagagatcatctggtccggtttttacggggcatccagaggcctgcttgccggactcagctaggtgttctggtgtgtacacccgacctgttctagtcataccttgcgcaacaattgcttcacctgtgcgtgcttttcctttcctccttgccccggctgtgtagtcccaaggtatggcatttgactgaaatggggttatatctgacatggagaccggaacgggcacccttggaggcaacatagtaacttcaagcggtgcgggtgcctttggagtcccgaactccacctcgatctgttttggcacctttgcaggaggtgcctcgaactcaaatggcgcggacaaattcaccacatccccctcagatggctggatctgtacaacaatagggttaagagtgaccgccggcttcttgggctcatctccctcagttatcaaaccaattgaccctttggggtcccaatcgtcctcaatttcaatcatgtggatacctccgcccttatggtccggtagggggttgttacgaacattaggagcgggctccatagctacaatgaccttgttgtcaattaaggtctggattttgtctttcaacgagcggcactcttcaatggtatggctcttcatccccgaatggtatgcgcagcttttatttgggttgatccattgggaagggttttttagggttatggctaggatgggtgtaacatatccggtggccttgagcttctcatacagttggtcaatgggttcggcaatagcggtatattgtctgggcggtttgcgatcaaagtttggtcttggtcgtggttagttctggcgggtaggtggtgatggatagtgtgagggttgggagttgtaggcttggtatacgggcgcgggttgggagtatcctggcgaggtgggttgatatgtgggcggtggaggtgattggtagacgggtggtgtgttttggtaattgggtgatggtgtttggaaatttagagagggttggtatgtgagtggggttggaggatatggttggtatttcaggggagagtggtttctctgcgcagccattacggagtttacgtcctttttcttcgacgtaccaccagattgcaaggtttgttagtggcctgcagtgcttcgaaattagtaaccataccgttcttaatgccttcctcgatcctttcttccagtttgatgatatcagagaacttttgcccctctatcagcatcaatctctcatagtactgcggatcctgagcacggacgaaaaatctgttcatttgttcttcttccaaagccagcctgaccttggcagcttccgacctccaatgagtagcatactcgcgaaaggtttcagtaggcttcttattcaaattctgaatatagaacacgtctagcgcattctcagtgttgaacctgaagcggtctatgaaatcagatgccatatcgacccagcttgcccatttccttgcgtcctggctgaggtaccaggacatggcgtcacctttcaaactcctcatgaacagcttcatgcggattttctcatcttttccgactccaaccagcttgtcacaatacattctgaggtgaaccctgggatcaccggtaccatcaaacatctcgaacttaggaggtttgtacccctccgggagttcgacatcgggttgaacacaaagatcctcatactttagaccttccatgcctttgttactttcgacaccccagatccggctggtcaattccttgagttcagcagccaagttcttgatgagtgaatccttgacatctgattctgacatatctgagatgggttggatatagtggggtaccgtgtctacaaagataggggtgtcttggttgtttggagtgttctggggctcggggataagcaatggagcattgttgcggatctgggtatgagtgggttgtggagtcttttgtggaggtgtagggatctggctattgacatctgcagcggtgagggtgattgataagtttgccaaattccgtacttggtctaattcctctcgaaacttcagtagagtttgctccagatgagcagcagtttctttggtgatcggagtgccctgagaagttccttcaatctcctttcttgctttgttatctcccatatttcctttgttcctgtttctgtgaggactcggaggaggaggaggaccctcagatcttgttgaatatgctgatggtgccagagcgcacgaactaacctttggggaggggaataacaaaaaggaaaaacaaaaaggtaagaagttagtgcggattctgagaaaagaaatattgctgtatttaagcacatagttgcaggaataaacatcgtttcctatttgggtgcctcgttgtgcccgaggtaggcctagcgacagatagaatttggagaacttataacaccaagtgcctcattttattgatagaaaatagaacgagttaaaaacaactgaaataaaagatattgttacttttaaccagtggccttattacatcaagaaagcagtaaaatcctaactacttggtcccagaaggaccttccccagattcggtatctttgcctccctcgtacagcttcatcaactcgcataatcccagcagcaggtaagcccgagccaagtgccctccttcgttaccttcagcttcctgacagttgttgatccttttcagaaacttgccttccagctccactaaacctcactccaaataccctatacgtttgtttgcgtggacagccatgtccttccattcattgatcagcttttcttgggcctcttgtatttcccgatgtttgctttcacactcccgcatccgttggcgtagctggttgtatttgacctttgctgcagtcttctcatcaataagtctgtgaccatggacgaaacccggctttcccaaaccaatgtgatcgtcttctaaccatcccggataaagtggtgtgtacccagcttgatacctatcgggttccatagattccttctccagaataagcttagagtgccacatatgctgagcctgacatctgtgtgggctatcgtcgtattggaagtcggccctgtagtgactcatcttttccacccttggtataatctgctttcttcctgcctacctcataactcggaaagggacataagggtaagttcctctcaagctgatgagcacaaggaatggcgcatccctagaccgaataatgaaatctcctgttggaaaccactcgtacatccattgtacctgctcctctttcagattttccaatagctctacccacccgctggcgtcttcagggtaagcgaacatatctggcatgaagcgcattcgctttgggtgatggaacgcgatatgatcatcccagtcccggcgtatgatttcttgtctatagtctcccttctgaaggtgttcaatgagccagagttgtagtaacaaattgcacccttcaaagtttggtgctccttgttgacaatgttctaaggctctgtatagttcggcgaggatcatgggcgctatgctgaatgtttgcccatcaataccctccattacagctttggttaccatggctagtcttgtgtggatcctagccttcttcattggaaacactatcatgcccaggaagcagaacatgaacacaaaagctctcctatgtatgtgcctcaaagaggtgagggcgaattcgtccatatgattgcggtaagatttgctatgtccgaacctttcatacatgaagtcgaaggatatgtaggagtccttcagactggtcagattgggattcttcttgagccacatcattttgaggaaccctctacccttgcggttctctggcataagcaatcccggactatcccagggaatcccggctagacccccaatttcttccagcagcggggtcattttaatatccccgaaacgaaagaccgaccgttcagtatcccaaaacaaagtagcagcttccacaatcttgttgtctggcctaactttcaggagtgagggaagatttcctaagtgcttgcgaaccataactcggtcactaccatgcaaatcctcccaccagcttagcaacctggggtgaatgttcgataccataccgaatctgtggacctcgtgcctcattttctgcaaaaaagagtgttaggccctaaccccaccagactcgactatttaaatcaacaattagcagtagggtatttagttctccaaataaatgcacataacgtgaaggtgtccgtttgggtttcgaagaaacccgatggacgtttggtttaggctatcttaatgagtcattacgcggacgacataactgactcggctaggttgaccatgatgcatgaacaattaaacagagtagggtttctacttttgaagtgctagacaaggtacccttgagcggacaactcaaaagggaaaggcacggaaccgtcgactacaccgttgatcgactggttttaccgcaaatatgcctttgccaaatttagggggtttataatattggaagagcgcaaccactaattataagtgttgctataggatttgtttggcacgagtggacgatgatgttgaaggatgcaattacaacaatgaaataaatacatgtattttcacgttcatacgataatgattacaataaatgctcggaattaaatacggaattgaaataaagtaaagacaataaagcggtgaaacagttaaagaaaaagaaagacatgaagaaacaagttattaatgggaagaaatgattaaagaaataaataaaggttaataaaaaaagcaataaagtcacaagacacgtaatggtaaaagccttaaagaaatccccagcggagtcgtcatgctgtcgacgccccctttttcaaaagtgaaatcgggtttacgacattatggacaaaacaactctcattccagtttaggaattgggttattgaattagaagagtcgccacctaatgattatagtgcattaggacactttaagatgaagagagtgtttttgaagagaaaaccaaagttgggtaagggcttgaggttatctcgaggggaaggtgttaggcacccctcaagatccacaaatgtggttcccggtcgtgctaattgtgactttaaaagaagatgaaataagtaggcaaataaggtgcacagatataatatttatataacttgaaagctttaaagaaaaggaaggacacaaatttgacataagagaggagtagtttgaaaagcattaagaaagcatttagataaagcaaataaagaagaagaagggtcctaggtttaactataatatggatcacatcggcacaataccccgcacacactcctcaaagaggggtcgcatatggtattagtgtaccggtcatcatctccatattctaccctcccaccccgttaaggtattaaaacgcgttggtatcatttacttattgcatgctaatacccgtcccaacctgttaatcctggggtattaggacttctaatcctaagaagggggagaaggagataggatatatatatggagtattcaaaggtaaaaatgctagagcgacagtcaaaaacaagtaacatacaagagggatgcaaataaacaactaaaggctcaaataaaccccgtaacatacagcaagtagtttagcatgacttcagttactgatttggtctttaaaagaggttagggggagcgggcagataagtttaaacataagagttggatagaaaatctgcttcgagctccccgggcccgttttagaagttgatagacttttaggaaatcagtaggacttttggaaaaaaatactagtcgcggacaggagtctattttaaaatatttagagttacaggcgagttttagaaaagaaaagtgcaagcttcagacagaagcttgtttaaaggattaaagctgcagacaagttttgaagaaaaggcctgtaaatcagtcgtataagttgagtaaagagagctgttagaggaggagttcaaaaccttaaagaagtttttaaaatattaaagcactggatctaagcaagcaagcaatcacaagttcaatatagaaaatatccttataggttcagaacatttacgaaaaagggcagacctgggctggacatgttttaaaataagccaagttaggagaagtttgcagaaactgagacgtttgaaggcattagcgggtttgaacttatgacttgtttattaccctttagttacagtttttacataattagacgtcctactgttttgcctagcgtttatatagttcctataggcatgctttgtaggtgagattataaaatgcgaacctaatagcatgatttctatatgaatttgatacagtacgaaaagcctatagacatggtatctatatggttgatgcaacgacataaaaataggcatggtaatagtatacatggataaaataaaggtcctaagacgtggtttgatgcaaagatgaataaacctatagtcatgattactatatgatactgatgcaatagtgagaaagctacggacatgatataaaaaaataagcaatcctataagcatgatctctaatgcatgtgagaaaagtaaatcccccatgcccctttcactatacccctgagttcttacattacaaattattacaaaactgggcaaagaagtaaagaacattaaagaagtaaaaagttgaaaatacaccagcagctataacaggcccgaggagtctcgaagcaattttaatgtccaacatatgccttttaccaaatccgagctcacaagatccgaggcttttctcttttagagggttacaaagttccaaaggctttcaaagagacccaggcattgcttacaccctaattggaatagtgcaagtgtggaattaccaaccctaaggcatccaagttcagaggagactccagggtccctaagcatggcttacccaaggggggtatgaacttaaaggactaagaataaatgcaaagtgaggatcagaggggaaaccagtgtatgaagtggtcatacccagcctattgaatgagactggcatacaccagactccttacaaaggttgcaaataggagcagacttgtaaacaagtcagacaagggcctggaagatgattaggacaccaacaggcctttatcaaggctcaaacacataagagaggggaaagggagtgggatcattctgagtataggcaattaaagccttggttctagattagaagtggtaatgaagtgccattctcatccaaaacaaactcataagcaaacagggactaaagggaaaggaaaatcacataaaggtattgaaagaacaagattaaaatgacccaagaaaccctctgaataacatgcaagcaaggaaaaggaaagggatgctagtcttactgaaatataaacaatcaaagggacatggaaaggggatcaatatgcagaaatttaaatacacaagcaggtaagagacaagggaaaagagttgaacatattgaaataataaaacagacaagggaatgagggaagggattaagcaggctagaaaaactgaaatgcataagcagacaagggaaacaactaaggattaaacatgctgaaagtataacagactgagaacaggatgaagtaaacaggcagctgaaggttggtaattaaaattggaagcctaccagttcaactggaataacagagcaagtgtgagtcattataattagcattggcttttagccggctaattcttagcaaagagagcaagtaacagagaagagaagagagtttgtagtgagtaagagtatagagaggtcgtgtatcagtgtgtgtgttgaactgaagttgttcgtgtcttttatagtttgaaaacaggcaagcaaataaggcaaaaataattcagtaccaattagaatcaatcagaggaagggaactcctttaattaaggagttcgaattcgaataggagaggacagagttgtatttaaggaaagaaaatcaataacacatggtgcaatcaagggtatatacatgagagaagcttttaaaactacacggttaggttaataaggtaaaggctaaatcaattatcacctagtaaatcaaggattcaaagattcgtacttaataatgaactaagtcaagaataggtccagatcaaataagggaagaatcaaataaggttacatagaaaatcaatccccaaaaattagggttattttgaaaggaatagcctaactataaagagatgcacagatttaaacatgcgaggctaaaaaaaataaacagagtagaagagcacagtcacgagatccataggtcttgcaaagcttagcaagaatcagagagtttagagagttagggtttcgaaatcaaacaggcagcaaacaatcacacacaaatgatgtgaaacccccaaaatctagggtttcttccacaagtcaagtctaaagacgaaagcatagcggatcagtcaaagaataaactcaaaaagtccaaagaacacaaacatacatggaagcttaatgaaagaagaacagtaaagaaactattcgaaaaccctagaaaaaaatacagtaaggagaatacatagaaaacacagataaacacttaggaattacaacaaagtaaaataatggaagaaatcacagtaagtcaagtagaaatcacggaaaccctaagtcttgagaagacgaatagtttttgaaaacacgactaggtgaagaaaaagatgagagatacttaaaaatcttagaaaacaaacaaaactcagagaagatcataggataaacacggaaaaatgaaaaagaacctcgaatcattagggttttcagagaaaggcctagaaatggcgagaaaagcctgaacggctcatcggagcttggcaaggacccaaggcttcaaagacttgccggagaacagccgtggaactccattgaaggacccatggtccagtcaccctcgaaacaaagtcccgatcttcaaacccaaaggccaagaaaggtgatgcgtggacgggcatggaagtttcaggcctttaacggccattaatgccggtgaagaggaccggagaagattagggttctcagagaacctagagagcatttgggagtgaaaggcggcggattggtgaaagtgagtatagggttaagggtttggggggtttaatttggtaagtaatgatatggccgttgatctatgagatcaacggccaggattagaagggggaaccaggcgggtttagtttagattgggtttgggtcggatattttaaattgggtcaggtgaattgggtttaagaatagggttgatttgggttccaatttaggctagaattgaaagagtaaagggttacaatttaaatagccccttttttccaaatttaattttataaaaatggtaaataatttataaaaatccgataaaattactgagagaataaaatatgtttaggaattaattaaaaatatcaggaatgattttgcacttgaaatacttattaaattgagaaataggctaaaattgcaatttaatgcaattttagttttaaagtacctaatggctttgtaaaatcctgtaaaaattacataaattatattttatataaatgagagaataaaataatttattcattaaaataaacaagatttggtactaaatattggattttttaaagtacaaaataagttgtaaattggttttaaaatgtttgaaaaattatagaaagataccaaacctcttgtggatgcttatatatgcattcacaagctattttgaaagtattttagttataaaaatatatagggaaaaattgggtatcaacaaagatatcttaaggggagaagtcccccacacaaggttagacaagccacttacctcgaaccggtacaaaaatcactacaaacgatgcccttaccacgagaatccaactccgaatggcccgaatctattcaaacaaattacataatgtaattaatattgcaagtaactaattacactattaaagttaaagctacgacgcgaaaataggtaaaatgaccaaaacgcccctcaggccaatgcctcggaatcgaataatttttatatttttagaaacctcgtactctcacgagtctaaccatataaaattctcccaaatcgaaggtcaaatgccccttcaaatcatcaaagttagatctaagaactttaccccaattttcatccaaaatccgaaattaaaggttgaatttgagattagattagtgggtaataatcataagggagtaaggaatcattacccaatcgttgcctctgaaaaaccctcgaaaaatctcccaaaatcgagctctctagcttgagtttttgtaaaaatggaagaagggttcattttgaaatgtttatatctgcccagggattttgttcaatgtgatcgcatgaatagggatgcaatcgcgtagaaggaattttgaaggcctgggaattggcctatgcgatcgcaaagtgaaggatgcaatcgcgtaagagggcaaggaagagctatgtgatcgcgtaaggaaccttgcgatcgcataaaggaaatggacccctgagccaccagctgcatttgttcagtgcgaacgcgtagaagaaggtgcgatcacagagaagaaggaagcaaacctatgcgatcgcgtacaagaagttgcggtcgcattgaaggaaaagagggcctcccacaaaagcactacgcgatcgcatgaagacctatgcgatcgcagagaagaactggcctgcaacacacagcaaattttctgcaatgttctaagttccggaattgctccgttgagcatccgaaacacacccgaggccctcgggacctcaaccaaacctacggaaatatcccataacatcattcgaacttgtaccaatctttaaaccacctaaaacaatgccggaaactcgaattaataaatgatttgcacttaaaaacttcaaaacttaaccaaactcgctttcgatcaaaaacctaaccaaaacacatccgattgacctgaaattttgcacgcacgtcccaaatgacatgacggtgctaagaaaacttacggaatcctgttccgatcctcggatcaaaaattcactatcggaccagaaactccaaaattccaactttcggcatttctagcctagttgagctacggacatccaaaacacattccggacacgctcccaaccccgaaatcacctaacggagctaacggaactatcgaatttccattccgaggtcgtcttgacactgttccgactacggccgttttccaactcttaagctctcacttagggactaagtgtcccaaaacactccgaattcacgtaccgaacatcccggtcaaaccaaaatagcagaaatgaacttaggggaagcagttaatggggaaagggggcgcaaattctaaaaacgaccggccgggttgttacacttcgcatttgcgaagccagcattcgcaaatgcgaagatgggccctggatagcctggtcgcaaatgcgatctcattcttcgcaaatgaggaggtccagccttcgcaaatgcgagccttttctcgcaaatgcgatccctccccttttggcctgagttcgcaaatgcgaactaaaatctcgcaattcccagacctgctgggttcgcaattgcgaacccaggttcgcatttcccatacctgcaacctgcatttttcatacttagacgattttaagcctcattttttatatttctcaaacccaaacacccattagcgatttttcacgaactctctcttctccaaatcatttgtaagtcaacttttacttaattttttcaattgtttaacatcatttatcatgttttcatcttaaaaatcaaggattttcatgggtgaaaatggggattttgaggtagatcctaggtttttttaaaattggagatttggacctcaatttgaggtccgatttcaaaataaatcatagatatgaactcgtagaggaatgggtaaccgggttttggttcgaacctcgggttttgaccgcgtaggcccgggggcattttgggaatttgtgggcaaaactttggaaattcattcttttgcattcaaattgattcaattagcatttgatgatacattcaagtaatttatgactagattctagcggttttgtggtgaattcgaggggtaaagctatactagaggcttgagttgagtttggagcattcgaggtaagtgtttgatctaactttagcttgagggaataggattagagtattgtttgctatttgctaagtattgagtgcggtgtataggcatggtgacgagtatctatacactggtgtctagcatgaccgtgagtccttacttgtacttactccgatattgttatgatgcttccgtgtttaattgatgatttctatgtaatgtgaagagtatgaggaataattatgagttgtaaactctttggagcattggctcgaacgataagaagactaatgagtaagaaatgaaagaactagaaagagatgtgattaatcccttaccgggatgttttgagtatattgattatttcccttgtcgggatgttttgagtatattgttgttgcaccattgccgggatttagctgtttgctttggtttcccttgccgggatatttagtactgtttatctatcccctcgccccgcttggttgtgattgttgattgggtgaggaagagtgatgatgcacgaagggtcatttcgtgccatattgaatatttatgcacgaagggtcattccgtgccatgtttgaatatttatacacaaagggtcattctttgccatgttctaaataattatgcacgaagattaatgcacgaagggacattccgtgccctgaatatgagaggttatgtgaggaaaatcacgaaggttgatgccgtgcactttatttgatttattgtagtgaggacgagagcaaaagcacgaaggtcggtgccgtgtaattattgatggatctgctctccttaactgttgttattgtacggtttcatttctctatccgttgattctatatctgaactgtacacccccatagcatgtttcccatcctcttagctatttaaattctgtatattttccttctattgcatatatctgcacatgttgtttttggtaggtcttgtctagcctcgtcactacttcaccggggttaggcccggcacttaccggcacatgagatcggttgtgctgatgctacactctgtgcatctttttgcacaaattcaggagcagcttttggaccttaacagtaggatttgatcgggagctgacttcagtccagggactttcgaggtagccttgccgacgtccgcaggccggagtcccttctatgttatttagtttgttttccttgtatcgagacaaatattgttgtatttctattcagcttgattttagcactctttagtagttcgtgagttagtgacaccggatctgggtaaagttatattggaacttctgtactgagtttcagttaattatgccttaagtcttccgtattcatgttaattatctcgtatttcctcattatgttaaaagaaatagctaaataattggctggcctagctcctaatagtagacgccatcacgactcccgaatggtggtaaatccgggtcgtgacatcttacctcgagcttccacggctaactcaagcctcaaataccactttttctttagaattcgcctttaaattacttatatctagtccaaattaatttaacaatatcaataaatgctaaagaatttatacccaatgcttaattataggttttctattattttttccaaaaagtcaaaaatcgaccccgggcctgcttggtcaaaactcgaggttcggaccaaaatccgatcacctattcacccacgagcccaaatatgcaattaatttcgaaatccgaccccaaaacgaggtctaaattctaattattcaaaaagcctaactcttcccaaattcctaatttctaccataaaatccctaaatatttggatgaagattgatgaaatgcaatgcgaaatcgaaagaaaaaggtttagaatcatataccaatgctttggggaagaacttgttccttgaaaatcgcctcaatgctctcaagctttgaaaatctcaaaatatgggctaaaaccccgattttgctactattttaagtgctgggcgatagtgttcatcgcgttcgcgagaacattatcgcgatcgcgaagagctgccagaagtggacttatgcgatcgtgagatctcctacgtgttcgcgaagggtaagccctctggccttcgcgttcccggacaacattacacattcgcgtagaagaaatgacaagtccccagcccgcctccatttttacactacgtgttcgcgatgagcaacccctcactgctccgcgttcgtgactgtggcttcacattcgcgaagaacaaatccaccccagtcccaatttccctttcgcgatcgcgagagttactacgcgatcttgatgcacaaaatgtctgtgcacctgaagcagcaaaacctacaacatttctaagtgtaaaaacatcccgaaacctaaccgaaactcacccgatccctcggggctccaaaccaaacatgcatactaactcaaaaatatcatacagacttactcgtgcgatcaaatcgccaaattaacacctttaacaatgaatttagcatcaaaaatcaaagaagaatctcgagaattcttaagttcaaattttaacaaccaagggtctaattcacgtcatatctagttcgtttcttaccaaattttacaggctcaacctatataccatataagacctgtaccgggctccgaaactcaaatacgggcccgataccatcaatttcaaatacatctaaatttccaaaaactcttaaaatttcagttaaataattttcttcaaaaatttatttctcgggcttgggacttcagaattcaatttcgggcatacgcctaagtctcatatttttctacggacctttcgagactgtcaaattatgggttcgggtccgtttacctaaaatgttggccgaaatcaacttaaattcactttttaaaggccaaatttgcattttcatcaaagtttcacatagaagcgtttcggatatacacgcggaccgcgcatggaaatcgagctgagataaaaggaggcttttaaggcctcggaatacaaaattgactcaaaaatcaagtgatgagcttttgggtcatcacaaacataaacaacataaataggtttttttgtcaataacataactaggttatttgtttcgtaacgagcaagagatcaccagaactcataaattttaaattctaaatccaccttaacctttagaattgatgaaaattctaagctccaactctacatcaaatagagatatacttgttttagtgagattaccttttttctcatggtgcatagcaatatggtaagcatctccgaaattcattatattgatgacatctagcatgattttaaacgtttaaaacttaatatatcgagtcgagtttaaggctatatacaagcaaatctttttaaaatgtggaatttataattataataaaaataacataaattacctataacaaaaaaataaaaataacctgcgtataaaattctttacactaatgatgtatatagttcaaactcattcgagaaaccacgtggtttttatttcaaaagagaactatagttgttttatcaattttgtgctaaggcctaaccacataaatgctgcccaacttttaccctcacaaaactttaaattaaagtaaatcagccatgcttttctactcagagtaatattaggtcctttggctaatcactagaatttaacaattactagcaattctatttaagttatggttttcaatcaaataaaggccaatatcaaattaattggctacatgaaatttaatcttgctatcgagagaccggttcctcaccttgtaatcttgtccctcattttcggttccctaccccttctatataataaaaataatttatttaaaaaggtatgattggcttattcctagactcaatccttaaaccaacttatttaatctcttaattaacatgattattaattgtaaagcgttagccaacttaagttccgtctcgctaattcggttcaagctattagtgcttatttcaattgagagcttatgtcacgatccgaattccccaccatgaggagtcatgatggcgcctactattggagctaggcaagccaagtattaaaacattttttctgataacctttcaacaatataaataaagcaagacatttagataaaagcggaagccttaaaacttagataactaaaagcaaatgccgaagtttaagtacatctctacctagaatctggtgtcaccaactcacaaactactagagagtactacaaacaaagtctgaaataaaagatacaatgcttttgttccgatacaaaagggaaacaagttaagtaaaataggaagggactccggcctgcagacgtcagctaggctacctcgaaagtccctggactgaagtcagctcccgggcaatcctactgctgcggtccaaaagctgctcctggatctgtgcaaaaagatgcacagagtatagcatcagcacaacagacctcatgtgctggtaagtgtctggcctaaccccggcgaagtagtgacgaggctagacaagacctaccaaaaataacttgtgcagatatacatatatatatatatatacgagtgcaacgaagtaataacagagaaatacaaagtaagttgggagggggacatgctattgggaataacaggtgaaaacaaattatcagaagtaaacagcaaaactacaacaatttccataacatatagtggtcggcgtgcctcacgatcccatatcatagtatataagtggtcggcgtgccacacgatcccatttcatagtatataagtggtcggcatgccacacgatcccattttatagtatataagtggtcggcgtgccacacgattccatttaatagcatataagaggtcggcgtgccacacgatcctattatataacatataagtgatcggcgtgccacacgatcccatatcatattaaatatagactttctagatgaggccccattaagggaattcaataacatatcgatttaatccggcaagggtacaactaacagctcaaccatcccgacaagggaggacacataaaatacttaaatcccagcaagggagcaacaacaacaataaactacacgtcccggcaagggaataatcacctcactttctcttttgatcatttcttactcaattatcaaatcatcgtccgattcaacgctccaagtaatttaccaatcataatttccttttcaaactcatcacattatatagaagtcaacaattaggtatggaagaatcacaactctatcacataattgcaagtaaggactcacggtcatgctagactctggtgtatagatactcgtcaccatgcctatacaccgtactcaacacttagcaattaacaactaatactctaatcctaatccctcaagccaaatttagatcaaacacttaccttgaaagctccaaaatcaactcaagcctctagtatagctttacccctcgaattcaccacaaaatcgctcaaatctagtcacaaattacttgaatgaatcaacaaatgctaattgaatcaatttgaatgcataagaatgaatttcccaagttttgcccaaaattcccaaagctccctcgggcccacgtggtcaaaacccgaggttcgaaccaaaacccgattacccattcccctacgagtttatatccatgatttgttttgaaatcggacctcaatttgaggtctaaatccccaattttaagaaaacctaggttctacccaaaattcctattttcacccatgaaaatccttgattttaagatgaaaacatgataaatgaggttaaagattgaagaaattaagtaaaagttaacttacaaatgatttgggaaacatagagttcttggaaaatcgcctatggagtttgggttttgaaagaatgaagtaatggggtttaaaattcgactaagtataaaaatgcaggttgcagacgtaggaaatgccaaactaggttcgcaattgcgaacccagcaggcttgggatttgcgaaggacttgttcgcatttgcgaactctgaagaaaagtgggaggttcacatttgcgagaaaactgccgcatttgcgaaggctgggctcatgggaaggcatcgcatttgcgatgaattacttcgaatttgcgaagactactacccaggggaaggatcgcatttgcgatgggaagttcgcaattgcgagtttgcttttgcgaagcctgcagaactgaaggataccagatttttcaaacgttcaaaatgcaactcgacacctatccaaatctcacccgagccctcggggctccaaaccaaacatacaaacaacctcaacaacatcatacggacttaatcgtgcgatcaaatcgccaaaataacatcatatacatagaatcaaacctcaaaacacatgatttcctttcaactttcataaaactctaattttttccattttaagtccgaatcacgtcaaatgacgtccgttttcaatcaaactttacagatagtgcttaaatcatatttaagacttgtaccgggtgtcggaaccaaaatacgagcccgataccataggtttatgatcaattttctttttcaatttccttaattaatttcagaaaataatttcacacaaaagttcatttctccggcttgggacctcagaattcgatcccgggcacacgcccaagttccatatttttctatggacccctacgggaccgtcaaatcacgagtgcgggtccgtttacccaaaacgttgaccaaagtcaatattatgcatataaatatcaaaattcaccatttttcacacagaactcatatttaagcttttcggctatgcgcccgaactgcgcatgcaaatcgaggcaaccctaaatgaggtttccaaggcctcgaagacacacacaagtgagaaaacaggtgatgatcctttgggtcgtcacattcgccacctctaaaataaccgtttgtcctcgaacggacaaaagaaagaagtacctgacatcacatgtaggaagtacatctcatctatactgacataaactaaatgcggacactgcagttaaatggaagatgcaaaccacagttaaatttgggaacataccaggaggatccacactacatacacctagatgacgcaaatcctgtctaataggatttgtcaaatcttgaggagatatagaccaaggtaacggcggcaagcatgccaacacttgagcagaaaatggtctgggatctatatcattctctattaataccacctaaagtgattacagaacaaatatagtgactattatttatcagcatcaacaaataaataaaatcctaataatttaagcatgtaaaataatataaaggtagctacaagcaaaggacaagaatgcccttagcacttgaaggttttcaacaaaaagccacaacagagaaacaacaaacagtctcgaaagtacatgacagaaaaggtagagaaggataatcagtttaaattttaaagagaacgaatgacattttaccacatacctctgtttcagtatccctatcacctatttccccaattgtcctgacatagtgaccggttggatatcgggacaaacgatcccatgaatcaaccgcaatgataattcgcttatccagcaaatttctcatgcattaatgctatttgatagatttcttgtgaaatacttatgccaggatgattcagactggagtgcagcagacgttctgttacgtgcaattagaactgcatttggccccgcatcaaaagtatatgcaacctggcaaacatttttatacttggtaacaagtaacaagaccatatacatttatttatgttactataaacctacttttaaaagccaaactagcaacgcaataggtcttccaaatgcaatatgtacacttgcaatctatgtaaactgaaaattagacgaccccaataatgcaacttagccaaacactcaattggcagtcagaacggaaaaaggcttgaaacggatagatgttcttgcatcgattgctatagtgtcaagatctcagtggtaatcgatattatgaagtaactcaaaagcagtaatctcgaacaagctcaagaccagggagaattcagttggaacataactcagtttgcagaatattcaaacaggatgtagatggaattggggagaggatgcaatacatttttgagaatgatacaaaagatccagttcagaaggataatcactattctgtctcaagtgtctaatatccacaattctagctcaagtattgaattctatgacaaatttctcgggcataataagtagaaggtaacaactcttacatttgtgttcttttacacagttaatagagaaataattattcatggatgaacaaaatcatgcaaatttgcattagaaaaagattacggtaaagtagaaaaacctgtgagttccttctgaacggttccatttctcaacacagctgattatcctgaaaattggacacaccattaagacttagtttctcctattctcgacattagttaaaaaaaatatcaaattcaattttattttattttaagaaaagaagttccgcaaacacctcattttagtatcttgaagttaagaaattacctatgagaagtgtcattcatgtggaatataggagggctagtatccaggcagactgcatgaaactgattgctgtctgcacaagtcaagtgagtgaaagttgcaaaatgacgtttttgtatggcttcttccatctgaattattcgctttggcactacttaatcccaatacaagaatgaaaagtcaatacttctaatacaactctcaccaattgaagagaggttaacttaaagaaccacgtgaaaatgtctggaagattttcaggacaccaatagaagatgcagaacccaaatgtaaacaagaggacaagagaaatacctttgccctgtgttctatcagcgcactggtttcaacagtctcaagcacaacctctgatttgagatataacttattgtttacaacaccactgtgaaatctcactaagctccattttccaccttttcctcccatttcaacttcttctccatcgtccaagtaaacttcacctgaactatttcccttgtcgctgatggcaacaacaagttcgaatggagtttcccgggctgcccttgttgtcattgcttctccttgcatcgccagaatatttccttctcgaaggtgtacgttgatatgatcagaaggtgcaactaggttgatgtagttaccggacttcatgttcacgtggtttgaatagttgaagaggtcgaaccaggttccagacggaaaatatgcattaactgaaaccgctccagatgttagcactggcgatatcattaatcccttaccaatgagaaactgagagccaatttcataagtgtttgtatcctcaggaaatgaaaagaaaagtggtcgcgctataggaacgcctctggaatgcgcctcaaacattagcgtgtagaagtatggtaagagccgatagcgaagtccaagcacctttttagttgttgcagctactgaatcccagagatatagctcttgatggatggtaaacttatcagaatgatcccttgaaaagggataaaatgcacctagctacatttgacgagacattgatattaacaaatgaacatcagattctgtatgagtattttaaccaaacaaagtgatgtatttatgaaaaccaacagactccataggattctgcactaaaatgacaacgctgttaatggaaaaaagtagactccctacattagaggcagatgcagtattgtattgtcggtttcatctgaatccagtactttcgacgttgtgcataaacttatgtgtaaaactcaacaaaaatgtaaaatatagtaggtctgaacctatatggattctataataagaaccttaaaggttgaacccgtagagcttaaatcctgaatccgccactgccctggattatacattggagcaagaggcgcaaagtaggagaataagacatcgtacgcagagatgggtattgaattatgcacgacttttgaactgtcaaacggaaatcataaactcgtgatatatgcaaaatactattactttaaagacaacagaacatgtacgtacctgaatccaacggcggcaaagttcctcagttgtatttttaccaaagccacatatatcagctccaaccataggaattccaaacaattccaaatttaaaatgctaggaatactataagccaagtcatcccaagttgcagcattatctccagtccaatgtgctgtatactttccagcacccacaaatgtagatctgccaagtataaatggccttttaccaataatgtcgattaaagcagcattggtcgttttagcttcgaggaatccatagaggttatgaacattgtactctaaggtattcccataatgtactgatgttgctgggacggtctatgcttattaaaggatctgaaaatctttgtccatgctatatatatcgtttcataagaacacgaatcccatgtacaagaatattaacctcggcaactatttgagtttctttcccaaaatcaatccaaaatctactgtaaatcgattgcaagcgactgatttaaccgggaaaaatagaagttaacaggggaagaagatggacgggcactacgtcaggctgttgacgcaacaacgagttgggaactgatttactgtaaatcaatagaccaacatcaatacaaaatctaatgtaaatcgattggaagaagagaagttaatttactgtaaatcgattctattggaaatcgattgtaaatcgaagagaagagaatttacctggaaaaagatgggctgccgttgacgcactcgtactgccattgacacagcgtaaatcacattaccattgacgcaacaacaagttaggttttttcggcagccaagtcgattcaagatagaaatcgattctactataaatcgattctactgtaaatcatcgagaagaatttacctggaaaaaaagatgggctgccattgacacactcgcacggccgttgacacaccgttgatgtagcagcgagtttggatttttcagccgcgatttagaattcaatgttttattgtttttctttcaactgaggagtgagttaggtttttcgtctattgttttctaattggggagggaaacgataaaaggtatcaaaaaaattggagggaaagattttctctttatggtggggagggattgttaaaataataaaagagtaatttaaattagtaatttttagtggctattatttttaattgccgataaaaagatatcttttactggctaatggtcatatgccgctaatatttaaacttaaagaatttattagcgaccattgccttattgccgttaaataattgctgccaaaagccttttttgtagtagtgtggggaatagatgaggataacggctccgcatatcagactcggactcccaggtcgatacctcaagaggccgacttctccactgaacacgcactgaaggaaaactcttcgacctcaactgtcaaacttgtcggtctaaaatagccaccggctcctccttataagacagatccttctccaattggacagtgctgaaatctaacacatgcaatggatcgccgtgatactttcggagcatagatacatgaaacactggatgcactgcggacaagctaggtggcaaggcaagtttataagccacctcccccacacgatcgagaatctcaaatggaccgatgaacctagggctaagcttgccctttttcccgaatctcatcacgcccttcataggcgatacacggagcaatacttggtcaccaaccatgaaagcaacatctctgaccttgaagtatgcataactcttctgtttggactgagctgtacgaagtcttcctgaataatccagaccttatccaaggcctcctgaaccaaatccgtacccaataaccgagcctctcccggctcaaaccatccaactggagaccgacatcgcctacaatacaacgcctcatatagagccatctgaatgctggactggtagctgttgttgtaggcgaactctgctaaagaaaaaaattggtcccacgagcctccaaaatcaataacacaggctcgaagaatatcctcaagaatctaaatagtcctctcggactgaccgtccgtctggggatgaaatattgtactcaactcaacctgggtgcccaactctcgctgaacctctctctagaaatgcgaggtaaactgcgtaccccgattcgaaatgatagatagcggcaccccatgaaggcgagcaatctctctgatgtagatctcagctaacctctcagatgaataggtggctgcaaccggaacaaaatgcgctgacttggtcagtctatcaacaatgacccaaactacatcaaacttctcccgggttatcggaaggccagtaacgaactccatcgtaatcctctcccacttccactcgggaagctcaatcctttgaaataaaccatcgggtctctgatgctcatagttaacctactgacagttcaaacatcgagccacatatgcaactatatccttctttatcctacgccaccaataatcctacctcagattctgatacatcttcgcggcgcccgggtgaatagaataccttgaacatgggcctccgctaagatcaactctcgaatcccatcaacattgggcacacaaactcgcccctgcaacctcaaaacaccattatcatctaaagtcactctcttggcacctccacgctgcaccgtgtctctcaggacacacaaatggggatcatcaaactgccgctcacgaatacactccaataataaaaatcgggcaaccgtgcaagctaacaccctattaggctcagaaatatccaacctcacaagatgattggccaaggcctgaacatccaaagcaagcgatctctagctgactggaatataagcaagactacccatgctggcggacctcctactcaatgcatcggccaccacattggcctttcccgggtgatacaggatagtaacatcataatctttcaacaactctaaccacctcctctgcctcaaattcaactccttctgcttgaacagatactgaagactcttgtgatcggtgtaaacctcacacgtcacaccatataggtaatgcctccaaatattcaaggcatgaacaatggcttccaactcaagatcatgaaccgaataattcttctcgtggatcttcaactgcctcgaagaataggcaatgactctgccgtcctacatcaatactgcaccaagcccaatacgggaagcatcacaatagactgtataaggccctgaacctgtgggcaaaaccaataccggtgccgtagtcagagctgtcttgagcttctgaaagctcgcctgacactcgtctgaccacctgaactgggcacccttctgggtcaacctggtcatcggggctgcaatcgatgaaaacccctccacgaaccgacttgctaaccccaagaaactccgaatctctgtagctgaagttggtcgaggccagttcttgactacctctatcttattcgggtccacctgaatgccttttgatgatacaacgtgacccagaaatgcaactgaactcaaactagaactcacacttcgagaactttgcatatcaaccactctgaggtgctgctcgtgatcctcctgactgcgggagtatatcagaatatcatcaataaagactatcacgaacaagtccaaataatgcctgaacactcggttcatcaactccatgaatgttgtcggggcattagtcaacccaaatgacatgaccaaaaactcataatgcccgtaccgaatgcgaaatgctgtcttagaggcatcagacgccctgatcctcagctgatggtaaccagatctcagatctatctttgaaaacaccctcgcaccctgaagctggtcgaataaatcgtcgatcctcggcagtggatacttgttattaatcattaccttgttcaattgtcggtaatcaatgcacatcttcatcgaaccatcctttttcttcacaaataacattggcgcaccccaaggcgagacactgggtctaatgaaacccttctcaagcaaatcctgaagctgatcctttaactctttcaactctggcggggccatgcgatacggcataatggaaatgggctgagtgcccggagccagatcaatacaaaaattgatatccctgtcgcgcggcatgctcggcaggtctgaagagaaaatcttggggaactcccaaacaataggaacagaatcaatggatgggacctctgcgctggaatcatgaacatacgccagataagctaagcacccattctcgaccatgtgtcgagccttcacatatgaaataacactgcgagtggtatagcctgggttccctttccactctagtcggggaaaatctggtaaagccaaggtcacggtcctggcatgacaatccaagatcgcatgatacggggacaaccaatccatccctaatataatgtcgaaatccaccatatctaagagcaacaaatcaacacgggtctcaagacccctaaacaccacaacgcaggaacgatgaactcggtcaaccactatagaatcacccaccggtgtagatacatatacaagaatactcaaggccttactaggcataaccaagtagggcgcaaaataggacgacacatatgaatatgtagacccagggtcaaatagcactgaagcatttctattacagactagaatagtacctgtaataacaacatctgatgactcagcctctcgcctggctagcaaagcataacatcggggctgggccccacttccctaaatcacatccttgggacgatcggctgttggctgaaccctacctctggcggtctgagctccacctctatgacctctacctccacctatatgtcctctacccccgcctctagctggctgggcaggctgtggggcaactagtgcctgaatcataggacgacgcccctactgctgagagctgctagaagctcgagggcaatacctggaaatatgactcatatcgccacacgtgaaacaagtcctcgactgctgggaataacgaagtgatggtgcactgataggtgctgatggtgaactgaaaagctgctggtcagaacactgcggctgagaaccacgaccacctgaagtaccatgtgagacctgtcgagctgactaaaagggcctcggaggatggcctctaccataagaatccctacctccagacgaggtaccattgaatattcctgcatgacggggcctcttattagagccatgaccacctccctgtgcaagtgccatctctatcctgtgggccgcattggccgcctcctgaaaggaaatctcactcccggctcccatagccatctgaagacggatcggctgaatcaagccatcaataaacctccgcaccctctccctatcggtggggagtataacaacagcatggcgagcaagatcaatgaaccgggtctcatactgtgtgactgtcatagagccctactggagacgctcaaactgcctgcgaagagcatctcgctgagtaactgggataaacttctccaaaaacaactctgcaaactgatcccatgtcaatgatggcgaccctgctagcatggctaaacaataatctctccaccaagtcttggcggatcctgctagacgaaaagtggcgaagtcgaccccgttggtctccacaatacccatagtccgtagaacctcatggcagctgaataagaaatcctgggcatcctctgaagaagtaccactgtatgtggtagtgaagagcttggtgaatcgatctaacctccacagagcatcggcagacatagccgcacaatcgccggtctgagccgcaatacccagctggactgccacaactggctgaaccgctggaacctgatcctgaggagctaccagctccggagtacatgtagcgggagtctgaactcctaccctagtctgagatgtggctggtgctactggaagcaaacccgatcgagagacgatatctataaagcctaccaatcggaccaaagcgtcctgaagcactagagtggctatgaatccctctgggacctgagctgggcccaccagagctgctggagctcgacctcctcatcataatcaacatgaggctccaccttcggactgctgctcggggctgacctctgcccctacctcggcctctggcactgcctcgcccactgcccctgataggagctgctactaggggctcgggctgctgcgcggtagaagaggaagcatgtgttctcgccatcaacgaaagaacagagtaaaaagacaatcagtacttgagaaaaagaatcgcacgacaagaaagaacaaagtgaaattttcctagctctgtagcctctaggggataaatacagatgtctccgtaccgatccctcagactctaccgagtttgtccgtgagttgtgagatctaagtaacctagagctctgataccaacttgtcacgacccggattttccaccatcgggagtcgtgatggcgcctactattggatctaggcaagccaagtattaaaacctttttccgataacctttcaacaatataaataaagcgagacatttggataaaagcggaagccttaaaacttatataattgaaagctcggaagtttaaatacatctctacctagaatctggtgtcaccaactcacgaactaccagagagtgctacaaacaaagtatgaaataaaagatacaatgcttttgttcggatacaaaagggaaacaatctaagtaaaataggaagagactccagcatgcggacgtcagctaggctacctcgaaagtccctggactgaagtcatctcccgggcaatcctactgctgcggtccaaaagttgctcctggatctatgcaaaaagatgcacagagtgtagcatcagcacaaccgaccccatgtgttggtaagtgcctggcctaaccccggcaaagtagtgacgaggctagacaggacctaccaaaaacaacctgtgcagatatacatatatatatatatacgagtgcaacgaagtaataacagagaaatacaaagtaatctgggagggggacatgatattgggaataacaggtgaaaacaaattatcagaagtaaacggcaaaactactacaatttccataacatatagtggtcggcgtgccacacaatctcatttcatagtatataagtggtcggcgtgccacacgatcccatttaatattatataagtggtcggcgtaccacacgatcccatttcatagtatataagtggtcggcacgccacacgatcccactgtataacatataaatggtcagcatgccacacgatcccatatcatattaaatatagactttctagaggaggccccattaagggaattcaataacatatcgatttaacccggcaagggtacaactaacagctcaaccatcccgacaagagagaacacataaaatacttaaatcccggaaagggagcaacaacaataataaactacacgtcccggtaagggaataatcacctcactttctcttttgatcatttcttactcaattatcaaatcatcgtccgagccaacactccaagtaatttaccaatcataatttccttttaaaactcatcacattatatagaagtcaacaattaggtgtggaaaaatcacaactctatcacataattacaagtaaggactcacggtcgtgctagactccggtgtatagatactcgtcaccatgcctatacatcatactcaacacttagcaattaacaaccaatactctaatcctaatccctcaagccaaagtttgattaaacacttacctcgaaagctccaaaatcaactgaagcctctagtatagctttattcctcgaattcaccacaaaaccactcgaatctagtcacaaattacttgaatgaatcaacaaatactaattgaatcaattttaatgcataagaataaatttttcaaaattttgcccaaaatttccaaaatgcccccgggcccacgtggtcaaaacccgaggttcaaacaaaaatccgattacccattcccccacgagttcatatccatgatttgttttgaaatcggacctcaaattgagatccaaatccccaattttaagaaaacctaggttctacccaaaatccccattttcacccatgaaaatctttgattttaagatgaaaaggtgataaatgatattacagattgaagaaattaagtaaaagttgacttacaaatgatttgggaaagatagagttcttggaaaatctcctatggagtttggattttgaaagaatgaagaaatggggtttaaaattcgactaagtataaaaatgtaggttgcagacgtgggaaatgccaaactgggttcgcaattacgaacccggcaggcttgggatttgcgaaggacttgttcgcatttgcgaactctgaagaaaagtgggaggttcgcatttgcgagaaaactgccacatttgcgaaggctgggctcatgggcaggcatcgcatttgtgatgaattacttggcatttgcgaagactgctacccaagggaaggatcacatttgcaatgggaagctcgcaattgcgaagcctacagaactgaaggataccaaatttttcaaaggttcaaaatgcaactcgacacctatccaaatctcacccgagccctcggggttccaaatcaaacatacacacaacttcaacaatatcctacagacttactcgtgcgatcaaatcgccaaaataacattatatacatataagcctcaaaatacatgatttcctttcaactttcataaaactctaattttttccattttaagtctgaatcacgtcaaatgacgtccgttttcaaccaaactttacagatagtgcttaaatcatatttaagacttgtaccggacgtcggaaccaaaatacgagctcgataccataggtttctgatcaattttcttttccaatttccttaattaatttcaaaaaacaatttcacacaaaaattcatttctcgggcttgggacctcagaattcgatcccgggcacacgcccaagtcccatatttttctacggaccctacgggaccgtcgaatcacgggaccgggtccgtttacccaaaacgttgaccgaagtcaatattatgcatattaatatcaaaattcaccatttttcatacagaactcatatttaagctttccggctacgcgtccagactgtgcacgtaaatcgagacaatcccaaataaggttttcaaggcctcgaaaacacacacaagtgaaaaaacaggtgatgatcctttgggtcgtcacaacttatttacgattaatcaaacaaaaatgaatatactcaagaggtgataggttacaccaaaatcctagtctcctagacataaagtgatgttatgctagttacagaccatggtaaaagaatacatcaacaaataaaaagaaaattcaacaaaagactataaaaagctctacaatattgatcttgtgaagtacaactagaacaattaaggggccgtttggccattaaaaagtttatttttttttaaaatcagtgtttggctatgaaattttcaattttcacttgaagataaatttcggaatttttcggaaattttaaaaactccaaaaagcaatttttcaaaattttacttcaaatcactcacaaaaattcaaaaatagtccaaaattgtattcatgtccaaacacaactctaactttcaaataccattttcaattgaaaaaaaaaattcactttcttccgaaaatttacaattcttatgtccaaacgcccactaagtttcttcatttaaaaatagttcaagccaccactataggaaataaaaataaaagagagaacaaatttgtaaaggtgaccaactaaatttggaacaataattgaaacttctgttgttgagaaggtctttgaacaccctttggaaaaaaaaaatcaactccagtacttctctgtaatagtcatcctctataacagcattataacacttcattataattgtcaagttttctttggaaccagtttcttatgttatgttataacttatattttctatatcaacactttattatttcaacaaaaaaatatcaaataaacaaaattgttacagagaaatttaacggtattaacataacttcttaaaaacaacaagcatcccacaacatttatttttcccaaaataggttatcttaaagttgcctaaacgagcacataggtgatataggtttggtcaccaaatctttcgttctaaagtttctataaataggagaaagaatgcaggaattttaattatcaacaaacattttagagttcattaattcatcaaaaaatggttttcaagtcaaatcttgtgcttatcaaattttctttgcttgtgtttctgatggttttctcggaggttgctgctagggatatgcctcctcagccttcacgcccattactcaaatgtaaattttctatcttggtaattttttttggtaagagggaaatccgtagccgctacaatttctgccaccgcctctagccttcggatgatcactttgtgcgcactaaataacatcttggtaatttttttagggtgaaaagggtaaaacgtaatagtcgttcacgtacggtatgaaatatctttatcatatgttatactataaggtcattcatactcttgctataagcaaatcatcaagctccaaatgataattttgaatcacagtaaaaagaaataaagcggtatggttcaatttgttcctaaagtaaattgacatgtgaaatccacatggtcaatgctagaggctccctgaagtcaagagaaaatatgagataatttgctaacgataaaggtatgaattaactcaaaatataacacatgataaagttaagacatcccataatacataaatgagtaaatttggatatttttcttcccgctaaaaaatgaaacaaaaaaaaagggccttctatttgcatgcatctttcattaggatctttatacaaatagtcatgcgaatttactgtttattttttctagccggtatgcataaattatatactgattatatataattatacacaatattaattctaaatggattatatatatttagtaaaaaagtaaatttgaaccgcttccccaataataaatgaaacaacgaaaaatttgtggataatcctaaaattaaactctgtcgaattttcagtaaaaatatcgcagtaaaaataccgataacgcttacttggaggcacttgcccctaaacaccggtcatgatcctaaattgggtcatgccgtgacataaacatgaagaaagaaaaagctcagtatttgttatgtttatttatggaacatgcattttctatttgaattaatttccattatattatctgagagaaactattaatacttgaatttgggtgcagcaaatgaagctcagagcacagctggatcgttgaatgacccaattaagccccaatttttgcaagccatgataccgatagtagcagatttagctattaattattgcatagagtgcaaatgttgtattcctgaataactgaaggatcatattcctcctattattatactgaatatatactaatgtaagctacgagtctaaataaaggaaacatcggaatagtctctttcacgattgatttcatgtatgacttatgagtttttccatggtaataatgaagttaattaaaaaacatttgtagtcatattcagggccggagctacagtgttggttgcaggaactcaataacttttattcaaaccttgtatttgtattaaaaaatccaatgaatatgtacaaaggagaaacgcagatgcactaatgaggaggtgcgagaggttagtcctggagagcctaaggagaggtagaggtagatcgaaaatacgtgattaggcaagatatgacgttgctccagttcaccgaggacatgatcatggataggaaggtgcggagtttgagaataaaggtaaagagttagaataggtcgtctagtgttatccttgtctgtacagtagttttgatacatgagttagtgctatttatgcactttcgtattccttgatttatgtgattacttgtcgttactttcgtttggccttctgattaggatactcagttttaatttagtatctttgtatttttgcttcggttttataactagtatgattgctgctgcctttccttttatctttcttaagccgagagttttttgggaaataatctctctgccttcttgaaggtagggataagttctgtgtacatactaccttccccaaaccctactttatgggattatactggatatgttgttgttgttattattttattaatttaaaactcagcaacataaaagaattataatcccgaacccataaggttcaaatcttaatttctctttctttgacgacactcctaataccaaaaacgccattgaaatcaacctcaattataatggagcttttttgattaactttttacgtgggtgtattggttctctggtaaactttctgtatttggtcaaaatcgtatgcctccaatttataggctcaaggatccatcctaggcccgagtccgggtgaagtcgagttcgaaacccgcataccagacttgagctagaagacagagtgcagtatccggatataggagtccgaggaataccgggaccaaatatgcttggccctgaaatagtaccgttattgatttgtaccagaatgagctaaattcttgccacgtccccaaagtcatggtgcaaatcctggaataaggttgtacgattccgtactatgcggttaaacagatataccaagaatattccttatttagggtttccctattatataaagaggaccccaatcatttgtaatatcatctagtcattgagcaaagaatatactctctactttttgctactgttcattataattgtcctttagctatattgttcttactttgcttttcctacttaattgttcttactgccctaagccacctcgaggtcattaagttcgaggtcactgctgctaagtaacattggtttgattcacttctatccttcatttctacttcatatttcttgattattaattggtattgaactaaatcacaaatctttaaaaccaccgatcaactttaattattactcatattttcgaggtaaaaagtttggcgcccattgtggggctaaagataatagtgattattgattttcatcacacacgttgtttttacgctttttcttgtcaaattttttttattcctaagctgaaacatgtctagtacacaaaatgcaccagttcatgacaacgaaggtcttagagaaaacaacagtataggggtcggtgtaccaccaataaaccctgagaaagtgccaaatatggagccagttgatatcagttcacataatgctctaaacgctaattcaggcacagaccccgtagggaatgaacgcatggaagcccaatctggtggccaaggagcacgaggaatgggagatggatgaatcagcctccaggtgatattcgagatgctgcaagctcagcaaatcgccatcactcagcttcaaatccagaataagactcggagcgtagttgaacatgaaaatactcgacatgttgaaccagaaccggaaaggtcgaacggaaataattcagggactgaccccaccattatgcggatgctcgaagagctcgccaagaggatcgagttcggagaaaagaagattgaaggaaatgaaaaaaatgtggagacttacaactcccgtgttgatcaaataccaggggtacctccggtcctgaaaggtttagatgccaagaagttcatacaaaaaccatttccttcgagtgtggctctgatgcccattccaaagaagttttgcatgcccgatacatccaaatataacgggacaatcgaccctaacgagcatattatttcatacacctgtggaatcaaaggaaatgacttgaatgacgatgaaatcgagtcagtattattgaaaaaagtttagggaaacactatcaaaaggagctatgatttggtatcacaacttagcccccaactctattgactcgtctgctatgttagcagatgccttcgtgaaagcacacgtcggggccataaaggtggacacaagaaaatcggacgtcttcaaaataaaacaacggaacaacgagatgctaagggtgttcgtgtccaggtttcaaatggaaagaatggaattgtcgcaggtctccgatgactgggcagtacatgcctttatgaaagttttgaatgaaatgagctcgattgcgtctcggcagctaaagcaacacttgatcgaatatccagctgtgacatgattggatgtgcacaatcgttaccagccaaaaattaggctcgaggacgactagttggtagccccatctggctcagttcatcataacagattcacagccaagccctcgagggacacaaaccgggaatcaagattcaacaaagaacagtatcagccatatgtcgatcgaaggaacagcggcccgagccgtaatgctcctcggagcgatcggagaaatgatcctggtcaaagttctcggggactcatgagtaagaccgagtttgataaacatgccaacctcgcagaggctctccgattatcggagtacaacttcagcatagatgcgttgggaattgtttctgctattgggaaaataaaaaatactaagtggcccaggccaatacaaaccgatcattatcaaaggaacccgaacttgatgtgcaactatcatgtcatacatggtcatagaatagaagattgcaagcagctaagggaagaagtggctcagttgttcaacgagggacaccttcgagaatttctaagtgattgagctaagaatcacttcagggaaaaggatgcaaggaaaactgagcaagaagaaccacaacatataatccacatgatcattggcgggtcgatgaccctcaacaacctgtgttcaagcgcaccaaagtatcaatcaccagagaaaaatgaactcggagctatatgcccaaggacgtcttatcattctgtgacgaggaagtagaaggcatatctcagcctcacaacgacaccctagtaatctctatccttttgaataaaattcaagttaaacatgttttagtggatccaggtagcttagcaaacataatcagatcaaaggtcgtggaacaacccggcctacaagatcagattgtacctgcatcccgggtcctgaatggcttcaacatggcaagcaaaacaacaaaggaaaaaattatcttgctagtgaacgtagccgggaccatagaagatacgaagttccatgtcatcaaaggtgatatgagatataacacgctcctcgggagaccatggatacacaacatgagggcatttccttcaactcttcactggatgatgaagttcccaaaagaggaaggagtgaaaacaatatacggagagcaacatgccgcaaaagagatatttgcgatcgaggaagtggtgccgataccagagccttcgacctcggagaaatcgagcatcaaaggtaaataggcatccaaatagcaatcaccacctccagcctcgatggaatcggagcaacaggtaatcgaagacgaagatgaggatttccttactccccgaatctttttgtcatcctgaagaatccgatgcaaccaaatcaaccatcgaggaaatggagcaggtctttttaatcgaatacatgcccgagaaaaaggtatacctgggaacaggactaacccccgaactcaggaaaaaaactcattcaattgtttattgataatatggattgctttgctttttcccatttagatattacagggaatccaccggaaatcaccacgcatcggctaagcaccgaccccagtttcaaaccggtgaagcaaaaaaggaggcctcagtccgaggtaaagcatgttgtcataaaggacgaggtaactaaacttcttaaaataggatctattcgggaggtaaagtaccccgagtggttagccaatggagttttagtacctaaaaaggaaacaaatttagaatgtgtgtatactataaggacttgaacaaagcatgtccaaaagattctttcccactgcccaacattgatcctatgatcgatgccatggccggccgcgagatcctgacttttctcgacacctactccgggtacaatcagattcagatgaacccgggggaccaggaaaagactttatttattactaaatttaggacttattgttacaatgtattgcctttcaggctaaaaaatgcaggagctacataccaacgcctagttaacaaattattcgaggaacaaataggtaaaacaatagaagtttacattgatgacatgttggttaagtccctgcgggcagaggaccatttgactcatttgcaggaaacattcgaaatcttgagaaaatacaacatggagctcaacccggagaaatgttctttcggagtcgggtcaagtaagttcctcggctttaaggtgtcgaatcggggcattgaaattaacctcgataagattaaggccatcgaggacatcacgatcgtggacagtatgaaggccgtgcaaagtttgatgggtagaatacctgctttgggtcgattcatttcgaggtcatcaaatcagagtcaccggttcttttccttgctaaaaaaaagacttcgcatggacccctgaatgtcagcatgccttggaggaattgatacgatacttatcaagcccgcctttgcttcacaccccgaaggtagatgaaaaactttacctatacttggcagtgtccgaaatagtagtaagtggggtactagttcgagaagagaaaggtaggcaattttctatttattacgtgagccaaactttaagggatgttgaaactaggtaccctcacttagaaaaattagcacttgcattgataagtgcatctcgaaagttaaaaccatattttcaatgtcatcttatatgtgtattaaccacttaccccctttgaaatgttttgcataagcccgagctattgggtcgattggccaaatgggtcgtcgaacttagcgggtacgatatagaatatcaacactgaacagccatcaagtctcaaatcctagctgacttcatggccgattttacatagaccctcgtacccgaagtggaggaagaactcctgctaagctcgtgtacaacatcgggggtatggacccttttcacggatggtgcttcgaatgtgaagggttcaaggctcggtattgtcttaaaaccacccatgggtgataccattaggcaatctatcaaaactccaagattaactaacaatgaggccgagtatgaagccatgattgcaggtctcgagctagccaaaagcttgggatcagaggtcatcaaggccaagtgcaattctctattggtggtaaaccaagtaaataaaagtttcggggttcgagaagatagaatgcaacggtacttggataagctacatgtaactttgcaccgcttcaaggagtggactctggatcatgtacctcgagaccaaaatagcgaggccgatgcacttgctaacctgggatcctcgatcaaagaagatgacatcgtcctggggaccgtcgtccaattattgaggtttgtggttgaagagggtcatgccgagataaattcaaatagtttaacatgggactggaggaattagtatatcgactatttgaagagtggaaaactctcatcagaccacaaagaatcgagggccttgcgagccaaggctgctaggtttacattagatgaagatggaacattgtaccgaagaaatttcgatggtccattggaggtatgtttggggacaggggattacgattatgttctttgaaatccaagaaggcacttgtgggaatcactccggcaccgagtcttttgttcggaaaatcatcagagcaggttactattgcaatagcatgaaaaaggatactaaagaatttgtcaaaaaatgtgataagtgtcaacgatttgcaccgatgatccatcagctcggagaacaactccattcagtcatatccatgtgtcctttcatgaaatggggaatggatatagttggccctccaccaatggccccaggtaaagctaagttcattttgtttatgaccgattatttttctaagtgggtggaagcataagccttcgagaagttccgagaaaaggaagttattgactttatctgggaccacatcatatgccgattcgagatacctgccgagattgtatgtgacaacggaaagcaattcatcggcaacaaggtaacagagttccacgaagcacataaaataaaaaggatttttcaacaccgtaccatccgattggaaatgggcaggccgagtcaataaacaaaactatcattcaaaacctaaagaaaaggttagacgatgcaaagggaaaatggagagaagttttacccgaggtcctttgggcatatcggacaacatcgaagtctagaatgggggccaccccgttttctctagtatatggttccaaggccatcatccctgtcgaggtcggggagcccagcgccaggttttgacatgcatcggaggaatcaaaccacgagtccatgaatgctaacctcgagttgttagataaaaagcgacaagcaatgcttgttcggatggccgcgcaaaagcaaaggatcgaaagatactacaatagaagaaccaacctttgacattttggaattggggacctagtcctacggaaaatcaccctcaattctcgagacccatatgaaggaaaattaggcccgaactaggaaggaccgtaccgagtcctggagttgtcggtaaaggatcttacaaacttagcacaatggaaggtcaacaactaccgaacaattggaacatatcattgctcaaacgagactactactaaggtatgactttatccgttttgaccatttgagtttaaaactaacttactacagattttcgatcgaagctatcgaaggcatacaatctcaaagatgccctttttacatgaatgccttaggttctaaagcatgcgttgtactctttttcccttagataggattttgtccctaatgggttttatcggaaaggttcttaacgaggcaacaactatgtgctatctaaggagaactcaatagtatccaaggtttcttttcaattaacctcgaatactgggggcaatcaccctcagaggttatatttttgagaaaaatactacacgcctatgagggcctcagtaggagaactttataatgggccaaacggtcaaatgaaccgtgtccatatagaatagttgagccctgatggaaaaacatgtacgcatgaatcaataatttgaagaagcattctggttatttcagaaacactttgtgtctcagagaagtttactatcataggagctttacacttgcaatccaaagggaagcgactcaagagccaaaacacaaatgcaccccaaaatactcaaggactatcgttgacagtcagcacatccgagtcatcaaaaactcggactcagaaaacctcaaagaggtagcccctcgaaacaaacgccaaggctaatatactcagggactaacttttcaaacaagtttgaaaagctatcgggaaacaactccaaatgacgtacccgaaggctacggccatattaaaaactatggtcatataaaggctacgtcaaaaataatgcgacttggagatgtccgacttcctccataatttaaaatccttcgaacatttaaaaaccggttaaatcaggctaacctcggcaaaagaaaaatataaagggcttcgataagttcagccctcggaaaatctgagggcttcgataaattcgaccctcaaataatccaaaggtttcaataacatcagccttcagaaaaaactcaagaggtattcgattatgtttacacaaataaattactaataagtttctgatacgacgaaccttcgaaaaacccaaacgggtacaaaaaatacatgctaaggcatacataaaattttacttagtcttttagccaaaagaggaaaaaattatagcaactttaaaggccgaacgacccaatttaaagagcctaagggccgatatataagagcctaagggccaacttaaaaaggcctaagggctaaaacatatagagatcgagatcctgttctcactcgactcaaactcgagaactctgacatcctgaactcacatcaaatcgatttaaaattatctcgaggattaacaaccctaagggatattatattgatcaaataaaaacctaagggtttactacgttcttagtccaaaccgatactcgagctgattatttgaattatcgaaataagaacaaaataaaattcaacacaagttgaggataaaacaaaaggataactcgtatttataagggaagttttacaaaaaaatatttacaatacccacaagggatccttacacaaaaacaaagaaacctaaaactactctggggccgtatcttcggtagctgcatctccgggagtcgcgccttcaagagcctcatctttgggatcttcttcttcatctcccccactattagagccactagctgaatcctcgtcattagaaagcaaagcggtggcctcttcttccaaagcccttgccttttcaatgtcggaagataagtcgaagtcgcgagcatgcacctcctcgagggtctctctacggggctgtcgtctggcgtggtcaagtgcacatgataacttgacttcagccacagtagagatatctcttgctcgggtgttgactgcctcggcgtcggctcggtacgaagatgcaattgccacagcatcagatttggccttatccagctcagcagcagattcagctttaaactcctcgatttcgcggccttgatctaggctctcctccttcacactttgaaagtggcattccagtgaagccagctgctctctaagagtttctttctcagaggagagattgtccatgcctttcctccaccccagggtctccacctccttcaccttgagctcctcccgaagctgctcgaccaactcgcccttctgctgaaactacataattgaagtattagtcgtcaaaacaaacaagtacacagcaaaccctcaaatgctatattaccttttcaacgatatcggtctgttcctgacaagacttcatcaacttaattcggagatcgttgatcttcccctctttcttggtatagaggattttaagaatgtccctctcttccgagatcttcttaagctcggcctcgcattgagaaaactcaattcaagacttagagaatgttttcttatgaagcattatggccttcacaaaaagggataggttagattcaaaaaaacaaggataaagtacaagcatgatttcaaaggacaaatacttacttgtttgaagagccgtcgggcctcatcgaaaatgaaagaagcatctgggtcggggccatcctcgaccccagaaaggcactctcaaaagatatcatgcccttcatggctcgttcccacatcgggagtctccatggtctgggcatttcggagttgccctttggaaaagaccaggccttgcggtgaatcatctatgctaatcaccccaagtgattcactgggatattatcttgtctttgaagagcctcagagttaggctcttctagctcatccaccaagcgtttcttgaggtaaggcaccccctttcactagaagacccagggactttgctcgagctctcctcagaaatttcttcggttcgaggtcaaaccattgctgccaccataggttcagcggccttcgaagcgttagagcttcctctttcacgagctaccaacaggcagtcgtcatcttcttctttttcctggtcccggaggcgttgggcaattttcggagataaagccatagtatcggccttaggctttcggaccgtgcttttcttccgctttggtgtatttacaggcgaccccctctttcttttcttttctttgggaggctttgagatctcttcttcaccaagtggaggcagccgcatttcggcagcttttccgaggcctgcaaaaaaatgaagtaagtattgcgttgaggaacacaagtaatcaaacaagaaaactcatcgtggttttctgcctcccatcggcccttggctaaatcacgccagtagtgctccgcatatgaagaagtagaggccagtttatggacccaaccctcgaggtccgggatcgcccaaggagaccaagcgacagctgcaccatcggagaatggttatatcgagaaaaagataaaatcatgaaagaaaaagggaagcaaggtataaagtcgctatgtacttacgtttcatgctccattcctcggggaatggcatcttctaagcaggaatcaagtcggaggtcctgactcgaacaaaccggctcatccatcattggtctttgtccttatcgatgatggagaagagatatttcaaggatcaacgttgttgttttatcaatccacctcggtatcgtcgaggattgtacagcctgattagatggtcaagagtgaaaggcatccccttgacctggctcgaaaaacatatgatcaaatgaaaaatttgttaaaatgaagggtagatctggccaagcatcacttgctaccgctggcagaagtcgagaataactggatctatgggacccggagttgaatttgcggggcgcagcatgaatgggtaggtgtacacgcttaagtaccctgctttatgagtagtgtgtcctcttctggggaagggatcaccacatctttgtcaccccagttgcaatctttctttacctgctcaagctcatccttggttatcaaacagatgtatcgtgacataggctcacattggcctggtgtcgatacgggtttttcaatcttaaaatcgaatgttatttcacgctgtgggggaatgcactcctcgatgcgaggtggcaccaccggtttacttctaaatggtcgtgatgacgaagagcttttttcttgttggggaacagtttaggtgttttagccatcgtgattcgaatgaaaaaaaaagtttgatgatgaagtaaagaacaaattgagaagaatgtgatttcagggaagttgaaggagctgacaagatttgggaacgaattgagaagtgaagtttgcaaaatcataaagttggcctatttataaaagccacttaagcgtattggggaagccaaaaggcagaccatcagccacctctaatttaatgacctaggaagttgcgcagatgtaacctttcagtcacttcagacactgacgtcacgagaatggcattatcagccacctctaattaatgacctaggaagctgcgcagacgtaacctttcagtcacttcagacgctgacgtcacgagaatggcatcatgatcgagacatcgaggagatcgagattcaagtcgtttcttatattctaaaaaatgcggggattatctgtatacggtcaaagtcatatacctccgatttataggcccaagggtccgtcctaggcccgagtccgggcaaggtcgagttcgaaatcggcatatcgaacttgagctcgaagacagagtgcaatatccggatataggagtccgaggaatactggggccaagtatgctcggccccgaaatagtaccgttatggatttgtaccagaatgagctaaactctttacacgaccccaaagtcatggcgcaaatcccggaataaggttgtacgattccgtactagacagttagacagttgtaccgagaatattccttactgtaactagaaatattccttatttaggggtcccctattatataaataggaccccaatcatttataacatcatctaatcattaagcaaagaatatactctctactttttgcatactgttcatcagaattgtcctttagctttcttgttcttactttgcgtttcctactttattgttcttactgccctaagtcacctcgaggtcattaagctcgaggtcactgctgctaagtaacattgatttgattcacttttatccttcatttctactttatattttttgattattaattggtattgaactaaattaaatatctttaaaatcattaattaaatttaattgttactcgtattttcgtggtaaacactttctttaaaatttttattgatttctgttggggatgcatgtctgcttcaacaataatcattggtttaatgtgattattaatatatacaagcatctttttatttacttagacttacttgttcgtgattgtatgtagaattaattgagagtcacaattcggggatataaattttttaggaaacctattacattggaatggattcctaaaggtatcttcttcttccaagtccttatatatatcatgtaccttttaataattattttaaatttcctttagagtatattctatgaagattaatttattaatttattattctgatcataatacttctaatattgttcactttaaaaatatttttttttttaattatgggtgtttgcggtaaaaaaaaaaaattactcattcttaaagttagtattgtgtcctttaaaaatattttttaaaatgtgggtattttgcagtaaaagattaacaattactcattcttaaattttattcatgtgacgacccaaagggtcatcaccgtaagtccttcctttttcgtgctttcgagacctcgaaaacctcttgtgtggttgcttcgacttgcgtgcgcagtccgggcgcgaagccggaatgtttttatgttaagaaacttgaattatatgtttgaaatgataaattttaagtataatattgatatgattgacttcggtcaacattttgggtaaacggacccggacccgtgttttggcggtctcggaaaatccgtagaaaaatatgggacccgggcgtattcccggaatcgaaatccgaggtcccaggcccgagaaaataatttttcagcttaattgatttctgttaatgtttaaggaaaatgaattagaaaaatgatcaaaaggttatggtatcgggctcgtatttttgttccgacgcccggtacaagtcataaataattgataagcactatctgtgaagttttatttgaatcggacgtcatttgacgtgtttcggacttgatatagaaatctttgagttttatgtgctaaagagtgaaatcatggttttgaggcttaattctttgttaatgatgttagtttagcgatttgatcgcacgagtaagtccgtagggtgttttgaggttgtgtgcatgtttgatttggagccccgagggctcgggagagttttggataggtgtcaggttcattttgcatagctggtacttgttgctggtgttgcagacctgcaggcttcgcaattgcgaagcctggttcgcatttgcgaacttggtccagtcccagctgatctcgcaattgcgagattccacttcgcaattgcgaagtccttctttcccttcaggcatcgcaaatgcgatgttttccttcgcaaaatcgaattccccccagccaaaccccagttcgcatttgcgaactcccatctcgcaaatgcgagccccttcctttcccagccctcttcgcaaatgcgaagaccgtctcgcaaatgcgaggtccgcacttcttcagcatttattcgcatttgcgaatttgtttctcgcaattgcgagttcccttccttggctgcccagttcgcaattgcgaatttaatctcgcaattacgaggtccgtgtctgtgcaaaatatatttaaccaattttaaatgttcattttcataatttcaaaacccaaaaccccattggcgattttctctcaactcttccttctccaaatcgattgtaagtccatttctacttgttttcttcaatacttatcatcatctaacatgatttcttcactaaatcaaagctttcataggttaaaaatgaaaattagggtagaagttaggtttttcatattatgagcttttggacctcgatttgaggtccgatttcaattctaattatagatataagctcgtggagaatgggtaacccgattttggtccgaccctcgagtttcgaccacgtgggcccgggggcgtttttggaatttttgggtaaaactttgggaaactcattcttatgcattcaaattagtttaactagcatttgttaatttatttgggtaattcatgattagatatcgttgtttgggaatcggattctagaggaaaggcggtgttagaggcttgattgctagattttcggcatcgaggtaagtgtttgatctaactttggcttgagggattaggattaggacattatttgttatgtgctatatggtgtcggtgtataggtttggtaacggttacctatgcgcccgagtcaagcatgaccgtgggtctcaatttccttcatttaatgttatgatatagattcttgttgttgaattgattcatatgatataaattgttgaagttaaatgaataatatgacttaaaggagaatttaatgagtgtaccttgccgaaatgtatggaattctgttgtagactctcccttgtcgggatattttggctgatagttgcacccttgccgggtttagatgaatatactattgtgttctccccaaaaggggcctacttgtgattgaatggaattggtattccatgtcgttgggatcgtgtgacgcgtcgtccacttgtatatcatattctgggatcgtgtggcacgccctccacctatgtattatgaacttgggatcgtgtggcgcgtcgtccactattgtacattgaatttgggatcgtgtggcgcgccgtccactatgtgtttttggcttaattgggaatctgtggccttattattgtgttagacttgttctttctgtctttactgtttcccccatgtcatgttcctccccgttttgcttatgtattctgttattattcctgcaattgcatagatacatcttgcacaggttatttgcagtatgtcacgaccctaattcaccaactgtgaacatgtcatgatggcacctggccggcgaggccaggtaagccgaactctttttaataagaaaagacaaatatcaactgaaataatataagaaatgcaataagtaccgcccggcacatacacttagcattataaaacctcttgaacaccatcccaaagacccggaaactcacgggcaacacaggctgagattttgaatataaccagctctaatcatccggaagtctaatacaagggagaacagaataactactatctaactacggatagagtagaaggaagactcgtaggatctgtggacgcggcagatgcatacctcaagtctcctgatggatgctccctgctactgctgataatgagccgtgccggaagtacctggatctgcacaacaaaggtgtgcagaagagtagcatgagtacaccacagcggtactcagtaagtgccaagcctaacctcggttgggtagtgacgaggaaggtcgaggccctactgagataaacaagtgcagaatatggatatgtaattgaaacagttaaataaacaggagaaaaaccagtaataatagagaattcgaatatctaacagtcaaacaagataaaatgtacacataagattatcgataaatgccaaatactcggaggatctcccaggaacccgtcctgtagtccttctatttcacttgcctcaaaggatctcccgggataccatcccgtagtccatttcatccgaaggatctcccgagataccgtcccgtagtccaactttccaaagtgcaggggaagctaccggaatcccacatccgtaatcccaaaataaacaacaaaggggatctaccggaatcccacatccgtagtcccaaattaaatgcgcaaacacaaccaaaatataccggactgaacatgagttaacaacatatagagcaaactagcctaacatgtttcatatattacatcaagagtaacataagcatttaaacagttaattatatctaatcatgcttttctaactaacacaggttgaactagcattttataacagtcgaataggcgaggaaacacattataagaaattcaagtaaggtggattttcaacaattagcacaagtgtacgcccttcacctcgcacacaaggcgtttaaatcaacaacaagcaatcctaggggaaaaggtcccccacacaagattagacaagccacttacctcgaaccggtaccaaaatcaatacgaagcgaagcccttgccacgagtatccaactccgaatggcccgaatctattataaccagttacaatatataaataacaacgcaattaactaattacactaaaaaattgaagctacagtgcgaaaataggtaaaatgaccaaaacgcccctcaggccaacgcctcggaatcagaatatttttacattttcagaaacctcgcactctcacgagtctaaccatataaaattcacccaaatcggaggttaaatggtccctcaaatcatcaaagttaggtctaagaactaaatcccaattttcatgccaaatccgaaattaaagcttgaattcgagtttagattagtgggtaataatcataagagagtaagaaatcgttgcctttgaaaacccctcgaaaaatctcctaaaaccgagctccctagcttgagttttcacaaaaatggaagaaagttcgtgtttgaacattaaatactgttccagggatttaatgaatcgcgaacgcgggctgcccacgcattcgcgtagaagaaaaagttaagtgactgagtttgtccttcacggtcgcaagggtgccatgcgaacgtggaggcttgaagcccagaagctatgcgaacgcgaccctggggacgcgaacgcgaagaggaactgaaggggggggtcaggggtgaactacgcgaacgcgaagcggggatgcgaacgcggaagggaaggttggcagtgcttcgcgaacgcggaaaggcccacgcgaacgcgatgaagagagagaggcaaagctacgcgaacgcggaagcacatcgcgattgcgtagaaggattttccttctgcaattttctgcaacaacattaaagttccaacttctccgttgagcatccgaaacacacccgaggcccccgggacctcaaccaaacctacgaacataacccataccatcatttggacttgtaccaatccttaaaccacctaaaacaacgccggaaacatgaattactcattgatttgaacttaaaatttccaaaacttaaccaaaatcatttttgatcaaaaacctatcctaaacacgtccgattgacctcaaatttcgcacgcacgtcccaaatgacgtgacggtgctacagaaacttccggaactactttctgaccctcggatcaaaaattcactattggaccggatattccaaattttcaacttttcggcatttctaggctaattgagctacggacatccaaaatacaatccggatacgctccaaccccgaaatcacctaacggagctaacagaaccatcgaatttccattccgaggttgtcttgacactgttctgactacggaccattttccaacacttaaactctcaaataaggactatttgtccaaaaatactccgaattcaaataccgaacatcccggcaaaccaaatagcataaataaacttaggggaagcagttaacgggggaacggggcgcaaattctaaaaatgaccggccgggtcgttacattctcccacacttaaacattcgttcgtcctcgaacgagcatagagaacatacctgaagcagcaaatagatgagggtaacggctgcgcatatcccgctcggtctcccaagtcgcctcctcaaccggccggccccgccactgaaccttcactgaggctatctccttagacctgagctttcgaacctgtctgtccaatattgtcacaggctcctcaacataggacaagtccttgtccaactggactgaagagaactccaacacatgagacggatcaccatgatacttccgaagcatcgagacatgaaataccggatgaaccccgaccaaactaggaggcaaagcaagctcgtaggcaacccttccaatctgcctcaaaatctcaaaagggccaataaatcttggactcaactttcctttctttccaaacctcatgacgcctttcataggcgaaacccggagtagaacccgctcaccgaccataaaggaaacatcgcgaaccttccaatccgcataactcttctgtctggactgggctgtacggagtcgatcctgaatcaccttaactttctccaccgcatcctgtaccaaatctgtacccaatagtctcgcctcacccggctcaaaccaacccaccggagatctacatctcctaccatataaagcctcatacggcgccatctggatgctagactgataactattattgtaagcaaactccgccaatggcaagaactgatcccaagaacttctaaactcaatcacgcacgcacggagcatatcctccaaaatctgaatagtgcgctcggactgtccgtccgtctgagggtgaaatgctgtactcatagtcacctgagtgcccaactcctgctgaacggtcctccagaaccgtgatgcaaactgaggacccctgtccgagatgacagtaactgggacactatgcaggcgaacaatctccctgatataaatctccgctaaccgctcggctgagtaagtagtacacactgggatgaaatgagcggacttggtcagccaatccacaatgacccaaatagaatcaaacttcttcgccgtcaacggaagaccaactacgaaatccatggtgattttctcccatttccactctggtatctcaatctgttgaagtaatccacccggcctctgatgctcagccttcacctgctggcagttgaggcatctagctatgaattccactatgtctttcttcatccgcctccaccagtaatgctgcctcaaatcctgatacatcttcgcggcacccggatggatggaataccgcgagctatgagcctctgctaagatcaactcccgaatatcatcaatatcgggtacacagaccctaccctgcatcctcaataccccgtcctctccaatagacacgtctctagcatcgccaagctcaactctacccctgagatcaagtaaatgggggtcatcatactgccgctccctgatacgatcgaacaaagaggatcgagagaccacacaagctagaatccgactaggctccgaaagatccaatctcacgaactgactggctaaggcctgaatatccatcgccataggcctctcagccgctggtagatatgccaaactacccaaactctctgcccggcgactcaaagtgtcggccaccacattggccttgcccgggtgatacagaatagtgatgtcataatccttcaacaactccatccatctcctctggcgcaaatttagatccttttgcttgaacaagtgctgcaagctccgatgatccatataaatctcacaaggcacgccatacaaatagtgacgccagatcttcaaggcatgaacaatagcggctaactcaagatcatgaacaggataattcttctcatgcaccttcaactgtctggacgcgtaggcaatcaccctaccgtcctgcatcaataccgctccaagaccaatcatcgaggcatcacaatagacagtataagagcccgaacctgaaggcaagataagaactggggctgtagtcaaagctgtcttgagcttctgaaagctcacctcgcactattccgtccactggaacggagcacccttctgggtcaatctggtcataggtgctgcgatagaagaaaacccctcaacaaatcgacggtagtaacccgccaagccaagaaaactgcgaatctcagtcgcgaagaaaggtctaggccaactctgtactgcctccaccttcttcggatcaacccaaataccctcgctcgacaccacatgacccaagaaggccacagaatccaaccagaactcacatttagagaatttggcatacaacttcttttctctcaaggcttgaagcactgtcctcaggtgctgctcatgctcttcccgactccgggagtaaataagaatatcatctatgaacacaataataaacaagtcgaggtatggctggaacacactgtgcatcaagtgcatgaaggcggctggggcattggtcagcccaaaagacatcactagaaactcgtaatggccataccgagtcctgaaggcagtcttcgggatatccggctcccgaatctttaactgatggtaccctgagcgcaaatcaatcttagaaaacacccgtgcgccctgaagctggtcaaatagattatcaatacgaggcaaaggataacggttcttcaccgtaaccttattcagctgacgatagtcaatacacatacgcatagtgccatcctttttctttacaaacaagacaggagcaccctacggtgaaacactggggcgaataaaacccttatcaagcaactcctgcaactgatctttctactccttcaactcaggaggagccatacagtaaggaggaataaatatgggctgagtgctcggcaacaggtcaataccaaaatcgatgtcccgattgggcggcatgcccggaagatcagctaggaacacatcgggatagtcccgtactacagggacagaatcaatagaaggggtatcaacactgacatcacgcacataagccaaatacgcggcacaccccttctcaaccattcgttgagccttaagataagagataactctgctgggagtgtgatcaacagtaccactccactcgatacgcggaacacgtggcatagacagcgtcacggtcttagcgtgacaatcaagaatagcaaaatggggcgacaaccagtccatgcccaagataatatcaaaatccaccatatggagtaataaaaggtcagctctggtctcaaaaccatggatagtaaccaaacacgaccgataaacgcggtccacaataagagaatctcccacaggagtagaaacataaacaggagaactcagggaatcccgggctacgcccaaatatggagcaaagtaagaagacacataagaataagtagagcctggatcaaatagaaccgatgcatcccagtgacaaaccagaataatacctgtgatgacagaatcggaggcaacagcctcggtacgagcaggcatagcattataacgggcctgacctccccctcgagggcgacctctacctcccctacccctgcctctggccggctgggcaggtggggtagcagctggagctgggacaatagcctgggaaccctgggaagcacgttggggctgtggagtctgagaagatgcacctctgcccaatctggggcaatccctaaccatgtggcgtgaatcgccacactcataacaagctctgggagggcgcggtggctatgactgactggccccgcccctactggactatcctctgtgagcaccccgcgcaggaggcgcgctagaaactggaggtgcataatatggctcctgagatctgggaggagctgaagtgccgctgggtgaaggaagagctgagtgaactgggcggcctgtatagcccctaccctgatgacctgctgatggagtccgggtgccagagtagcgacccgactctcgagccctcttggcctccctctcatcacgctctgtagcgtgtagaccctcaatcctccgagcaatgttcactacctgctagtacggaatatccatctcaagatctcgggccatggtagatctgataggaggaataagaccctctatgaacctgcgaaccctctcgcgtaccgtggcaaccaaggcaggtgcatgcctagccaacctggtataacggatggcatactcagaaactaacatagtaccctggcgtagatgctcaaactcctctcgccaagcatctctgagactctggggaatgaactccctctcaaacatagcattaaactgagcccaagtcagggaggcagcctggtccggactggatagctcaaaagtatgccaccaatcataggtagctccccgaagctggaaagccgcaaaagagaccccgctcgtagcagtaatacccatggtgcggaaaatgcgatgacaatcctccaaatactccaaggcatcctccttggccaatctgctgaataccggagggtcatacttcttaaacctctctaacctcccctgctcatcctctgaggcaggtatctcatcctccgactgaaccggtgcggcaggctgaatatgaacaataccaggagcctgatcaacatgcactcgctgctctggagtgcgggcggcgggagtctgtgctcctcccccggcctgagaagtggctgcaggaaggggtagcagccctgcctgagataatgcagtataggcactcataaactgggccagtgcctcctgaatagctggagtagtggtggctgtgggcgtgtcgggcgtctgagccccgactggaacggctggcggtatctcagtagcagctcgcgcaggtgctatggctgcaccacgtgcgcgtccacgacctcggcccctgcctctaacggctataggaggggtgcgggtgcctgatcatcctgggtcgtgcgtgtcctcaccatctgtgagagaatagaaagacagaagttagatttggtgtccaaaaatatcgcacgacaaggaattcaaataaagtgaagattttcctaaacagttacatagcccctcgtagataagtacagacgtctccgtaccgatcagcgagactctaaataaccggcctgtgttccgtgactcctatgaacctagagctctgataccaacttgtcacgaccatagttcaccaactgtgaacatgtcatgatggcacctggccggcgaggccaggtaagtcgaactcaatgcggaatataacattttaataagaaaagacaaatatcaactgaaataatataagaaatgtaataagtgccgcccggcacatacacttagcattataaaatctcctgaacaccatcccaaagacccgaaaactcacgggcaacacaagttgagattctgaatataaccagctctaatcatccggaagtctaatacaagggagaacagaataactactatctaactacggatagagtagaaggaagactcgtaggatctgcggacgcgacagatgcatacctcaagtctcctgatggatgctccctgctactgctgataatgagccgtgccggaagtacctggatctacacaacaaaggtgtgcagaagagtagcatgagtacaccacagcggtactcagtaagtgccaagactaacctcggttaggtagtgacgaggaaggtcgagcccctactgagataaacaagtgcagaatatggatcggtaattgaaacagttaaataaacaggagaaaaaccagtaataacagagaattcgaatatctaacagtcaaacaagataaaatgtacacagaagattatcgataaatgccaaatactcggaggatctcccgggaacccgtcctgtagtccttctatttcacttgcctcaaaggatctcccgggataccgttccgtagtccatttcatccgaaggatctcccggataccgtcccgtagtccaactttccaaagtgcagggggagctaccggaatcccacatccgtagtcccaaaataaacaacaaaggggatctaccggaatcccacatccgtagtcccaaattaaatgcgcaaacacaaccaaaatataccggactgaacatgagttaataacagatagagcaaactagcctaacatgcttcacatattacatcaagagtaacataaacatttaaacagttaattatatctaatcatgcttttctaactaacacaggttgaactagcattttataacagtcgaataagcgaggaaacacagtataagaaattcaagtaaggtagatttttaataattagcacaagtgtacgcccgtcacctcgcacacaaggcgtttaaatcaacaacaagcaatcctaggggaaaagatcccccacacaaggttagacaagccacttacctcgaaccggtaccaaaatcaatacgaagcgaaaccctttctacgagtatccaactccgagtggcccgaatctattataaccagttacaatatataaataacaatgtaattaactaattacactaaaaaaattaaagctacggtgcgaaaataggtaaaataaccaaaatgcccctcaggccaactcctcggaatcagaatatttttatattttcagaaacctcgcactctcacgagtctaaccatataaaattcaccgaaatcggaggtcaaatggtccctcaaatcatcaaagttaggtctaagaactaaaccccaattttcatgccaaatccgaaattaaagcttgaattcgagtttagattagtgggtaataatcataagagagtaagaaatcgttacccaatcattgcctttgaaaacccctcgaaaaatctcccaaaaccgagctccctagcttgagttttcacaaaaatggaaaaaagttcgtgtttgaacattaaatactgttccagggatttaatgaatcgcgaacgctggctgcccacacgttcgcgtagaagaaaaagttaagtggctgagtttgtccttcgcgatcgcaagggtgccatgctaacgcggaggcttgaagcctggaagctatgcgaacgcgaccctggggatgcgaacgcaaagaagaactgaagggggggtcaggggtgaactacgcgaacgcgaagcggggatgcgaacgcggaagggaaggctggcagtgcttcgcgaacgcggaaaggcccacgcgaatgcgatgaagagagagaggcaaagctacacgaacgcggaagcacatcgcgatcgcgtagaaggattttccttctgcaattttctgcaacaattttaaagttccaacttctccgttgagcatccgaaacacacccgaggcccacgggacctcaaccaaacctacgaacataacccataacatcatttggacttgtaccaatccttaaaccacctaaaacaacgccgaaaatacgaattactcattgatttgaacttaaaatttccaaaacttaaccaaaatcattttcgatcaaaaacctatcctaaacacatccgattgacctgaaattttgcacgcacgtcccaaatgacctgacggtgctacagcaacttccggaactccgttccgaccctcggatcaaaaattcactattggaccggatattccaaatttccaactttcggcatttctaggctaattgagctacggacatccaaaatacaatccggacacgctcccaaccccgaaatcacctaacggagctaacggaaccatcggatttccattccgaggtcgtcttgacactgttcggactacagaccattttccaacacttagacctcaaataaggactatttgtccaaaaacactccgaattcaaatatcgaacatcccggcaaaccaaattagcataaataaacttaggggaagcagttaatgggggaacggggcgcaaattctaaaaatgaacggccgggtcgttacacggtaggtcctgtctagcctcgtcactacctcgccggggttaggccagacacttaccagcacatggggtcggttgtgctgatactacacttctgtgccctttttgtgcacagatccgggagcaaccttcggacagcagcagcagccgtagatagggagcacgccttcagtccagagactgctaggtagcttgccggcgttcgtgggcccctcagtctcctcttacttatgtagtttgtttcttgtttcggacaaacaatctatatatctctctctttcagaccattatttgtagtaaatcgtagcgatccgtgagtgctgtgacactatttctgggcagaggttctagttgtttctatttctgcactatatttctattattaaattaagtttgagacttccgtaatgttatttaccgtttccaattattattctgtcaaattttatagtggtttatttcttgcttagtggcttgcctagctccgacagtaggcgtcatcacaaccccgatgatgaaaaatttgggtcgtgacaattcacttcgacaatgagatttgagctcaggaaatcctcctctccagctttggcgatgattacaaaaaggggatgattattggtttaagaacaaggatttttaaactttagatacaatgaaagaattcaaattatccaactaaataacaagattatgactatagagcatagacatggcgtataatttggtaattgtttctttagaaacttgattcataatttatattttttggctattcttaattttgattaagcaagtatttctattattttgtttttttacaaatagtgtctattattaggtttataaataatagttatgtgaagtctttattttaaacaaatattttactaccatttgtttagaaagaaagataaaaagctagaaaaataacaaccataaataatgatactaacacatgatggattagcttcattattgttgttggaagacttttattgagtatgatttttcctttaatgcattagtatttttttcatgaacttaggtttttttttttaattttttttttataatagaaatatttttttttaacacgttcaacaatgcgattgtgtctctcgttcaacacaaatcgcaacgtgttaacgcgttgtataaatcgtatttcggcaatcgttttataatcgaatttcagtaatgtattttataaatcgtattaagtgattacgttttatagatcacatttgcttgcatttgtttttgactattatgttttacacccttaactttactttaaagtagatacactttttttttgaagattaaagatattatattgaaaattatataattttcaaaagccataaaggtagaaaagttcattactatctaggcatatataatattactctaatttcttaaactgttgaaatattttagagacataagagttggaggtttgctgcctttataaagcgtgaaaattcattcaaatgaagttcccaaaaattcctagcctaagtggcggtggcacaataaatattacgggttcgacaaaactcgataatttttactaataacataaatagattattgattctataacaagcaaaaggttgctagaacttgtaaattttaaattttgaatttgccttaaccttcccaattgatgaacatttagctcaaactctacggcattaagactaacaacatctagcatgattttaaatgtttaaaacttaatatagagtttaagtaatatacactgtattataaatgatttttaggggaggagatagagtgcggagaatgggaattcgatcgaacccagtaactttggttcgaactttatatttgtcttaaaaaattagtataatatatataaattattaatttagaacctaataacttaaggcgactaaaatcatgaactcataaatttaaatcttggttccacctataatgattttatactattagattacctaaaagatataaacaagtaagttttcttaaaatgtgggatttataataataaaaataaattaccaaccaaaaggaataaataagacctcataatataaaatatatataacttaaactcattagagaaaaccacattggttttattttaaaagagaaccatagttgttttatcaattttgtgctaagacctaaccatataaatgctgcccaacttttaccctcacaaaactttaaattaaagtaaatcaaccatgctgctgtatatgccttcaacctaaacctttaaattaattaattttacacaaacggtgattaattaatttcttatttgttgctgcttttctaaaaaaaaaattatctgttgctccgttcttcttttttttttttttttagaagatttataaggcttatggtattgatttttcttattctcctaatgacaaattaattaacacgttcttattcaatcgcatctcgcattttgctcttcggagtaatataaaaaggtatgattgtttttattgctaaactcaatcgttaaaccaaattaattaatctcttaattaaatgtgattattcgttgtaaatcattagcctctcaagaggtgataccatggtaaaagaatataatacatcaatcacgccaaaataaacaatcaagaaatacaaagaagaattcaacaaaaaattatagaaaagctcttcattgatcttgatcaagccaacgcaataggaaataaaaataaaaataaagaaaaaaaaaagaagaaaaaaaagaacaaatttgtaaagttgaccagctaaatatggaacaattaagtgaaacttttgttgtagagaaggtctctgaacacccttttgaacaattaaaatattcactaatcatgcttttctatctaaaaatagctcggccaacactatgggaaataaaaatataaataaaaaagaacaaattgaaatgtcaccagctaaatatgggacaatttattgatgcacggagtagatcgtttggaaattttaatttttttagtattagtaatgtttcggttaggttttcttaaattacggggtggacccatggaatatcttagggtgcggcccttcttcgaaccagaagcggattcagaatttcaagagaatggatgcactattgtaaagtggttatctagaatttatatttgacatgtttaactttagtctcttaccatgaacccactatacttttgaaattataggttcaaaattatattcttttcaaaattttagtgattttcacgtatgtatctatacaccatgcagaaaacaagaccatccgtagtgagatttgaatggccaacttcacctgtagagatgcaccaataattaatgcaccatcggagtctttgagcatggatgcacacacacatatgtaacaccccgtaaatacggcttaggtatgaatgagttaaaggagtagtaaggttatattttgaacatgtgaagtcccatcgggatgattatgggtgaaaatagttgattcaaaatcaagatggaatgtaaggtgcataagactcgacaaaatcgactaagtttgtaaaaggtacatcttccagtaaggtttagtgaaaacgtgtaaggaatttgggaaaactcagagaatgaaaattgtaggcctttgaaatagcttgtcaacgatatattatggagcccaaacggatctctgtgtaaaaagttatgtgcattttatagaacaatatgcgatatgtgcgcccggtagctcgcccatagtgagaccgtgctaattttgaggcagtgttactgctgttttgcacggtcagtagtgtgggaaggtctctaggtgtgcgggcgtgcttgtggggggtcgttttaaggccatatttcgtcctccacaacctcaaaatataaaaacttgctctagaaagggaagctcacaaaaaccaaactcacttaagggtccttccatcacccaaggtaagttctaatggtgattctaagttatttttaattttttaatatcttattaacatgggtaaaccctccaaatcattagatattcgtttggagcatcattattgagagaagaaaccctagaactcgaattcaagaagattgaacgtcaaaaaggtaacgtttcaccctctaattgattctagcatttgattaataattattgacataagatatgagttgatgagtttgatagaaaagcatgaacaattataggtttggcttgttgattattggttaagggtgttgtttatcttataggtgaagaagaatgacattgattataagaaatttgaaattttagaatttatctaggatcaagagaatggcttgttgggcgtagaaacaccattaataaggactatgaagctttatgtcaccaagtgtttgacaaaatacctaagtaaccaaaacatgagaattattgctaatatagaatccctttgacttgtattgatatagattaaagttgaaacggttggcgaatgttgtattacactcaagagcaggaagttaaggtatgtgaggctaactctctatgtttgggaatgttaatgattctccctacactacgtttcttttaccacgttaccaattgcctcataaatatagttaagcctagttccttgaatagttgtagaacttctattctctagcttcaaaactcgttcatgactttcattctaacgttgtaagctcagttcgtatttaatatagacttgggcttgatgtccctgagtctcagtatagcttactcagcatgttataaacagttaaagtttcagtgttcataatcagttcaagaatacatgtctcagtctaatcctatatttcagtattgtgtaattcagtgtgatccagcattccagtatcatgtaaatttaatgtgatttagtatttcactatcatgtattgcagtatgattctcagtttctgattttaaattcctgaatgttgaacacctgtatttgggcttgaggccgtagtttatatgttttatgcatacttgggcctgatgccgtagtttatgctttatgcatgtttgggcctgaggccgtagtttatgctttatgcattttgggactgaggttgtagttatgtatacgtatacttgggccagaggccatagcttgtgcacatatatattgggcccgaggccgtagcttattcagataaacaagttgttcatcattcagaagagagagtattcatatccttacttcatttatcatttcagttatcagttatcagttcagtcaccagttatcagttatcatttcagttatccgttatcatttcagtttcagtttcaatagttatcatttcagttatcaattataaattctcagttatcagtttggttatcagtttggtttcagtttcagcatttataattctttctttcagttgccttacatatcagtgcaattcaaatgtactgacgtcccttttgcccggagcctgcatctcacgatgcaggtactgatttacaggttgatgattcagagcgctaggactctcgtgtcagctctttggtgatccccagttcttttggggcattatcattactacagtctttagtattttcagatagtcagtgtcacgacccgtattttccaccatcgggagtcatgatggtgcttactattaggagctaggcaagccaacattcaaccattttaactaacattttcgataatataattagaacggagcaaataaaataagcggaagtctcaaatataattaactgaaggaaatgcgaaaagtttaacaaaatcctctacccaagattggtatcacaatactcacgaacttctaggatttactaaatacaatcgtctgaaagaaatcataacaatctgtttcaatacaaaagctaacaaactgaataaagatagaagagactccgggcctgcggacgtcaacaaagctacctcaagagtccctggactgaaggtctactcccgatctgctactgctgcggtccgtaagctgctccctgatctgtgcacaaaaatgcacagagtgtagcatcagcacaaccgacctcatgtgctggtaagtgcctggcctaacccagacgaggtagtgacgaggctagacaggacctaccacaaataacctatacagatatatgtgcaataataggaaatacactaatttaagcaattaaagggaggggagcatgcggtggggtacgacagttcaaatatagaaatcatcggtaaagaagtgaaactgagcaataacaactgataaggaaaacacaggaagtctttacatacgaaaacaatacactcggtccatatttcgttgcggcgcgcaacccgatcctcaacatatatcactgttgcggcgtgcaacccgatcctcaacaattaataccattgcggcgtgcaacccgatccttattatttatcaacaccgttgcggcgtgcaatctgatcctcaacatttaataccaagaactcacccaaacaacgaccgtagctcaagtgcgaggggagtaacaacaattacaataaatcccggcagggaaatacaattaacaactcaaatatcccggcaaagggagaatacaataaatactcacatcccggcaagggaataatcacaacacgttccacttttaatcacttatttcttgggtaacaatttctagtccgagccagtgctccaaatgacagaccaatcacaaacccttctcaactattcactttatgttaaacttatcaaccaagcaggaaagatgtatcattaaatccgaatccaacacatataagacttacggtcatgctagactccggtgcatagataacagtcaccatgcctatacaccgtactccacaattagcaagtagcaaataatatcctaatcttaatccctcaagccaaagttagaacaaacacttaccttggtccgaatatagcaatcaactctcaaacaccatctttcctctagaatccaactccgaaacaatgatatctaggcacaatttagttcaatattatcaataatggctcaaaaatacaatcccatagcctagaaatgaatttcctatcattcttccaaaatttccaaaattcgaccccgggcccatatggtccaaactcgaggctcggaccaaaacccgatcacccataaccccacgagttcaaatatgcaatttattttaagattcgaccccaaattggggttgaatcacccaaaagcctaactctacccaaaacccccattttctaccttgatttcatgatttagggcaaggaaattaataattaggtgaagaaattaggagggaaggaagttaggaacacttacccaagaagctatggtggaagggaagcttgaaaatcgcctatggactgctgaagaaaagagttcgtgtgaaaaatagggaagaatcccgtaatgacactgttctggaattaaataatagctaggcgaaaattggtctatgcgatcgcaggaagggggttgcgagcgcatagagataggaggctaggcattgcgttggcataaagggagctgcgttcgcatagaggaaaaacaggtcctattccgggttgggtcttcacactgtgcgatcgcgaggagggagtgcgatcgcattgaacaaggacggctactctacgcgatcgcaggagctgtgatgcgatcgcactgaagaaaagagacacctagagtttaaccttatatgatcgcagaaggcctatgcgatcgcatagcactgcatatcagaataacagaattgagtttttttgcaacttctctaagtccgaaaatactccgaaacacctccgaaacattttcgagccctcgaggctcctaaccaaacacacacactaactcaacaacatcctacgaactcgtttgatcgatcaaatcgctaaaatagcatcaaaatcaaagaatcaaccctcaaattcctcattttcatttcaaagttcataaagttccaactttagatatttaggtccgaaacacgtcaaacgacgtccgatttcaaccaaatttcacaagaagcgcttaatatatatttaagacctataccgggtgtcggaacgaaaatacgatcccgatacctatattttctaattcattttctggtatgggttaatgaggtagagactatgaaaggaccaagtacaactgcagaggcggatgcacgcctaaggaagcattgtcacgcaacaccgcttggctatgtacttgattttgctctaagaggtcagaggttcaatcctcaactagctcatttttttgcaaatattgtagagagcatttattcccttagaaaagttcctgcgtacgcccctgagtacaagggggttctttaggtattctgccaataataaaattaagatatttctatagtaaattttgacattttccccatagaaaacgaaacaaagagaaaaaattaaggcatctatttgcatatgcatctttcattttctattattattattattatctaagagaaatactattgtacttgaatttgggtgcagcaaatgaagctcagagtacaactgggacgttgaatgacccaattaagccccaatggtcgtggagcgatgcaattattggttcatattgcacagtgtgcgattgttgtgatccctaaaaactgaaggatcatactcctccttattaatatactagtaggggtagcccgggcttcgcccggacccaacgtaaacaaaacctacattgtttatagagataatacataaaaaccccatcaaacttgtcctaaaaagccattttcacatctgaactttgcgggcgtcctaacaccccacgattgtttaacaaactgtatttatttagcccctccgtagacctgagccaactaacataagttgagtgatatacacgcgcttatttagttaagccacgtaattattaaactcatccacctatattaaatatataccaccgtctcttttaacccattaaccccctccgtcaaaattcccaaaatgaaccctaacattttaccccaaaatcgatctcctcaatcctaaaggctgaccaaaatcgaagggatcaaaattgaagggatctgttgcacatcctaacgatttccttcttcttgctcctctacttctgttggtgattgttccagttcatgatttggttgaagagctgttcgaagttgaaggactttgaagaatcaagtgcaaacgagtctctttgttttagtttggaggtaaacacatcaaccctagccttttctatcatcaaccctaagtgtgtatctctattttattttgtttaatagcatccgtgtctatggttttgaagtcgcttccaatttcttcaatgtaatcttatctgtgtaaaatcgtgaacaaaaatacaattttgaaggtgtaataataaccaattttttattttttcttgttgcatgttttctgacctcttctgtaaaaattagaaattaattactttaatttctactatattcagggattcccaaaatgtcttttgtacttgttactctaagatttttccatggtggaaaaatcagcatggataagttggatttcttttcaatggaggattatattggtggtgtaatgactgactgttttgatgtagatgttgataggttctcttactttgagttcttaggttatgtaagagattttggttacaatgctgcttctgctgttatttatgtgagaccacctaactgtcctgctttggtactagttaaagttgatagggacctgatgggtatttgtgaagacttaaaaaatggggatattttggaggtttatgtagagcacatggttgaagaacctttagtggacccccacctattagaatatgttagccaagttggggatgatagtaatgttacttttgattttgaatctggtcaacatgtgggggttgtgagggtgtgggacaaagtgaaaaggcatccaatgctgctgaaaatagtcccaataatacagtccccacagctgttactacagatgataactcctcaaactcctcatctgaatcaaacctctcaaactcctcatctgaatcaagctcagattcagagtctgaggagttgtctgaagaaggagaagctgaatatggtagtgatacacatgatgaatacagggcatttagggcagaaagcaggattgtaaagaggaagaggaaagaaagtgcttctaaagagaagactgttaaactaggtaagagagggccagatgtggggtatgatgaatatgcatctaggaagaagaaaaagactttagaagggaagttaggtggtgatgagcctttttatccctcagatgaagctgctagttttgagacagatccagatgatgctgatgatgaagttgaaggggaggtgcaacagaaagttaaagctagaagaagaaagaattcaaggagagttgtatttgacaatacttgcaagcagatagtgtgggaaactggacttgcatttgcaagtgtgaaagaatttagagaggctttaactaaatatgctatcaaagaaaagaaatctctagaaaagtatgtaaatgaacctacaagggtgagggttaggtgcaagaaggcatcctgtccttggctgctatgtgctagttatgattcaaggactaaggattttgtagtcaagaactacaatccagttcacaaatgtgactctactaacagaaacaagttttgtaattcaaggtatttggctaaaaagttcaatgagaggataaaagatgaacctaatattataatatgcaagtttcaagaggtgattagaaagaaactgggcttgtatgttgggaggacagtttgtaggagggcaaaacatattgtgttgaaagagataatgggtgatcataaattggagtatgggaggattttagattatagggatgagttgcttagatctaatcctgttagtacatgtgtagttaagcttagtgaggaaacttttgaaggtgggaagaaacagtttgttgggttctacatttgttttgatgcaatgaagaagtcatacctagctggatgtaggccatgtattgggctggatgggtgttttttgaaaggggtttgcaaaggacaactacttgtagcagtttgcaaagatggaaataatcagatgcttccacttgcttgggctgttgtggaaattgaaaatcagcacacttggaggtggtttgtcagcattttaaaggcagatcttgaacttggggatggtacaaacttgaccataataacagacatgcaaaaagtaatcctactgattttatgctactgttttatactatatttttggttactgctgcaaaactgaccatcttttttctgactatgtttatgtttcagggacttcaaaatgctatatcagatctactccctaattctgagcataggatgtgtgtcaggcatatcctagctaactggtcaaagaaatggaggggcatagagagaaggaactgcttctggaggtgtgcaaggtctacatatgaatgggagttgaagaaaaatctgaatgacatgaagaacttggggagtaacatagttgatgaactgttgtactacaacattgaaagatagagtaaggtatatttcaacacttactgcaagtctgatagtgttgacaacaacatggcagaatgtttcaatgcctggattttggcagcaaggcagaagaccatagtgactatgttggaagagattagggtgaagatgatgaatagaatagctcagctaagacagtttggaaacacttggattactgaattttcaccaatggccatgaaagtgttagaagagaatactgaaaggtcaatgaagtgtaccattttctggaatggtgagtttggttttgaagtgaagcaaggaatgggtagtactgaagttaagcatttggtggacatcaataggcaaacttgcacctgcagagcttggatgttaaaaggcataccatgtgctcatgcagttgttgcctttcatttcaagaatttggagccaataagctatatttctcattggtacagtaatgaaacctatatgagaacatacagccacttccttcagcctgccttgtctatgaatatgtggccagagtcacaaaatccatctgttttaccaccttctttgaagaagatgcctggaaggccaaagaaagttagaagaaaagagcctggtgaaaataagacaggaaaattgtccaagggtggagtggaaatgacctgtagcaattgtcataacaagggtcataacaagaggggatgtgctaaggctgctggaaggtctactgctgcaacctcatcaaggtctacaagtgttggaagttcaaagccaccaaagcaaagcactggaagaggaaggggaaggcctacaggttctaaagaaaaggtgaacttcttccctttaatgtgttgttgtcttttttcaataattatcacatttataattttccttgtttcatataggatgtttgttctacaagtcagaaaagaacacattttaaggctccaaggatggttggaatgggtgttttacacactcaaagtggcttcaaaattcataatgtaagtccaacacttgctatgatatttatgtgataccaatttctgattatctgttggtttatggcagcctgggatgtcctctacaaactttagagatgtgaggtcctcggcagaagttactggagatctaggccatcgaccaacaagaggtgtaaagtggaagggtaaagaagctatggcatctaggcagctgcagcaattgagaggcaagaagataatacaaacaaggtctaaggctgttaagttgagccaagaaagcacaaccaatgcaaatcaacccagcttatgaaaattgcagttctttttgaaaattgtccactgtttttggtttgcaaacaacaattctgtatgttgacaagttaatataggtagctatagactactttgtaacaaactaccattatgttttggttatgtcgactggaatactattttgttgtttggttatgtcgactggaatactacttttacgcaactaatgcaatatgtttgagtgtttgaagttcaaacacttagcttaaataactgttatgtctgggtttgtaatgtatggtattaatgtttgttctccaaaaacttagcttaaatatggctgtccgtttgggtgtattgaaacaacaacaaatgagacttccaaattgagaagcaaaacatacatattgttgacagttccattgataggcaaaacatacaaagtgtttgaacttcaacaaaacattgctaaactccattgctaagcaaaacattgctaaactacattcaaaatggcaacctcattgcatcttctttcaatgagatccctggatacccacaagcaacaagagtaatacacatacccaatataataaaccatagtacattttccctactctttaacttagctaattgagtcttccacttcttttccttctctttcatcttctccatatcatcttgcaatttcaccaactgaacctcaatcttcttcatcttgtcatcttctatggtgttttcaacctttacagtagtccgcaacttagcaagattttcaaagccttctaatgcattctcaagttcacccattttttcaagcaactttgaaataacaaatttggatctacgatcaatttcagaatctttccaaacccaaaaatcacaagaacgaggaccctaagatgattaacaaaagaaaattaatgaatggtaatttatcacaaatcaataagtgaaacaattttaagaaacatttaccccatagtgtggacaaacccaatatcttcttcctgggttccgaggggtccaagcggttaacaatggcagcacatagccatggttgcatcgaatttctccacttgaatcattttcttcctcttccgtgcaaagccttgtcaaattctttccttttgaaggcattggtacaaatattaaaacttcaagaaggatttttgattgattttcgaaagaaattagaagaagaagaagaagaagaagaagaaattagggttcttcattgggttttggtaaatatttggggaagatgggtttttaccgtttgggggcttatattaacgttaatgaattatcttttttcctttttttgggctgttttaaacaattaatacacaactgacgcgctcaatttggatgtcaaacacgcgcagctgcccaggtctacggaggggttaaataaatacagtttgttaaacaatcgtggggtgttaggacgcccgcaaagttcagatgtgaaaatgactttttaggacaagtttgatgggttttttatgtattatctcttgtttatattgtgtacttcttattcccaccataatatttggccattcacaccataatatttggccattcacttgtcaggatgtctcacaatttttttgaatatttcgttattatttttggaagtactaaagagagagataaataatactacaattgtaaataaaagtacatgtgataatatctgcaaagacccaaaagcaaagcgtagaaagtttttattctttaccttctaaaattcagtttccaacatcatataagttcgcgaccacactaaaagttaattatcaaagacaacagcgtaatgtcaagccaaaaaggttcaactcattatcgcactgctttagccaccaatccatcaatacaaggctcttacatatagtatgttggcaatcaaaatatataaatgagcaaattagaacgttgagtccacagtcttatatattctttaattttgtagaaggaaaaaaaggataacatgagataccaataaatgaaaaaagctgaaaaaatataatttgagctgctcttgttccacgagcatggtggttcatcaaaagatgtatgtacatgttgcaaactcaaagctagctgcagccaagcttcttctcgctgaaatttctcaaaccgaatcacacaacaaaaatggagaagcgaaaaatcatattagcagagataatagttgctcaaacatcaattttaccctaaaaagaataaagttttttctctgttaatcaagcaagtagtaaacaaaaataagaagcaaaatgtatcacattagcagagataatagctgctcaaacaggagaaataaaatgtatcgcatttgcagagataatattgattctcaaacatcaactttacccacaaagagaatgaaatttcttctccactaatcaagcaagtagttaagcaaaatatagctggacatatcatgaatacactaaactctaaggacaactactaaattgagtactactactacactaaattttaattactcgcaataaattgataaattttgaaagacttttaagtttcttccaaagagtagaacaaagttaaagaaggcgtactatcatcatttattaaatcctaagagaagtgaacccagtaaatttaagttgagcggaagaatcagttaaaatttagaccttagtgatgccataattagtacctaagagatgctggacttttaggcaagaatcaccttgacaaaaactgaaatatttcagctggtgccaagcttttcaatcacagaaagttagaaagacaacaggaatgaatctaacaaaaatgcttaagctaaaaagcgttccgtcatttttcgttgaagagacttttttatattctgctttacttctgaaacttctccaccagaaaataatatagagtattgaatccttcttctcatgactttagaaccacaaattcactcaagagaatgcttattcatattttatgtggcaaagtttgaataagcgcgaagattaagaaaaaaaaaccttttgaaatttgtggtttaaataatattatagatatttttatgtctataaatcatcttattaagggtaaaataaaaaatttaaagttaagttatatacaaaatttggaagttgtctttcttttacacaaactatcatacaaccctttagcagtgtatcagtttctatgacatgccaaaaagataccacacctcgatatttacaccactggcgtgagcacaaacaatgactatcgtcaaagaacagtatagatagtcacaatagcacaacttgtagaaagaaaaatggtgcacgatattaactattagcagtacaacggggaagaggacatagaatatgttaataagagccaacatgtacaaatataaaaagataagatagttggttacttgtgcattgctaagcccattgtgcaagtctgttgctaacaccgaatgtaacagaaacgtcagtagttctacaaagaaaaaataagttgcagtcatagtcaacatcaagtacgacacattatgctttggaaatactcataaaattattctctacagaaagtgtaagatcacagtctcaaaattaatagtatagataagaaagaagataattgttgtaagctctattaccagataccaaatatgtgaatctgctgtgaaagaaagtaaagaagaaactaaaacttgtgatctcttccactatttcttgtgcatcaaataaatgttagctactgttatttcgtaccaaatatcttcccctttcaacttaagaagacaatgtccatcgattaactatatcattgaagttttttccataaaatatcccactgtcactatattttttcattttaagtaattaattagttggtaataatgattgatagatctattcctgcttttattaatatttccaaatgataagaagaaatgccatgaagtaagtcaaaatggattagtacacagttaaagcctaattaggtaacaacaatcaatcataacgaatagataaatttagacgattgatacattagcaaaaatttcccctgattgttttctttgttggttattgtacatattaatagccgtatgactggaaacctacgtttgtactgaacctacacttttattttttcgtctgtaagctgagttgctacaacagttcaagaaggtatatttcataaagtgatcaaaagatattgtggattcctgaaagagcgccatacagttacagttcacagtgatagaggtgtcctaatttagtaagtagaatcacgctacgctaaactctaacaaccaggaacaaatatcactaaaagaatagccataaggaaataaaacgcagtgaaaaagaagtggcagcacccgagaatatcacagcacaccatctagaacctaagaaaagtctaggagcagtcacgccttaaacatacgtcattatgtcacaacactaaatgagattgtaaagctggttgaaagaaaggactaccttagcatgagataatgaatacaccaaattcaattgtttgtaaataataggtcagttaatatgaaggaaaataatggtcaccttagagcagcctttgagtggaagaatgacacaagatatctaggtggtagtaattcttgattgtttgcagagcataactcgtatttctcgatagcacatcaagtgcaaaatacaggactgcaaccttcaacaaaacaaacaacagaaaaataaggagattcaagtccaaaactgagtaatatccaaaaacctaaatggcatatgtaaagtccgaccttcgccatattagtgcagataatacttgtcagtatctcaaccaatatgtttagaaagcaaaagctagagcagtttcacttatcctcattatattgctgataacttacctaaattggtttgtctatttgtattagaatttgctttaactttgtcgtagacactctcatttctttctccgagaatttgaggtggttaaagaagaacatgtttgattcgaatggttcgtaatatagttttcacagagatatagtcttcttttagtatattttgcgatatgtaatcttttttcaggtgtttttttctatataagatacaatccactatggtttaaaccttcaaatatgcgaaaaccccaatttctttttaagcagttttttgagtttcacaaaaatttaagataaaattataatgaatattcgaacaacccaacaaaaaccgaaacaaaacagaaaagacacccccatgaaggaaaagaaacaacacaataaaactaaccttttaatcatgtgattatcttgagtaaatatagaattgcaaaaacacaataaaagtcacaatctcctgttaaactatcctgcaatatataacagaaattgatgcgcaacatgcaaaaagatagaaatcagcggagaagccaagaaaatctaaacaaagagatagagatgcggaggaaaatcttggtattacagagaattaagcggtgatagtcaggttagcttgcgaaattacctatgtaacctttctctaaacagctcaaatccgtcggtacagggataccacaggaattttttatagcacaataacactgtgaagacgaaattgccctccggcaagcagacttgttgatgaacttctaacaatcttttaaagaaagtagaatagcagaaaaaataaaataaagagagcttagaattcacataagatatccaaaataaattaataaaaacagagaacaaatcaaaattcaacctcagtttgttttcacctttctgaaacggatcttaagactaaactgaagaaaagatcgctaatcaagccaaaaccccaaagatgaagaagaaaaagttgaacagaaaccataaataaaatgaagtgctggagtgatgggaataaacctgctctttatgatagatgtgaatgggaaaaggctaactgctctaatttcgttaaattattaggtgaggcttttggggtaattgatgctcaacctggaagtggatgcttctaacaagttctgctgaatgaattttagcgttgaggaattgggagtccacgtgttggcaaaggtagaaagagtcagcagctatagggttgagctgtaaattaatgaaattacaaaataccccaggcaaattagaaaaattcaaggaaacacacacgttgacggagaggtgcctgtattccctcttctaataagtaggaactaaataaatataatactttgttaaataacatgagattacatcaagaaccattactttctacttttctcataatatataatacgagttgttagaaaaattatatatctatattatattaaaagcacgaaggcctttagcgaaatgtcgttcgccttttttaccctttaaaaatatatttcacacaaggcaaaatagtcatttaattatttttctattattaggaatagttattcttctaatatttaggaattcaaaatcaactaaattttatgtataacttttttccttatttgagctatgtaatttaacagattcgtaaaagaaatcttaataacaattttaaccgagtaagtccctctagatattttaggtaaaagtttcgattacttcattacttaagttaaggacactttatataaaggggaacatattgtactttaggtataaattgatatggtaattaattgtataggcatcaattaatgagtatacgtttatagattaaacacaaattcctaaatattttaggtcaaaatttccataacttttcaactcctttatgtctaggagtattttttttttttaaagttgctgagttaaatgattgcgttaaccggtcattgtttattagttttgaaggttttcccctctatttatattcctattcgccttcacgtgtaggtacttcatcgtttctcaaatcttctctttttaatgtatatttaatttgtttttttttagcttgtgcatatgatttcagaattgtcgtctgataatatattgtgtttggaaaacaaactaattatttagtggaactagatgattattttctattagactttaatgccaaactgatgttcctaaggctcgatttgtagccagcgtgtatatagaaaataagaattcttgacaattttatgtccttttttaagcttttcttgcatgttatcgggttatgttcattgtttaggtagataaatatcttattgtttctttcatgaaattttatttggatcatcgataacaattttaaatcgctaattctatctttatgtgtgtttctgtgaaagtgataggtcgaaaactattctatatagcaagaagaattatggagcagtaagtctctctctaattggtataatttcttataaatatctttatctattttcagtctctgtcgtcatgctacattatgttatttatctactaattggcgattatattggcataaatagcatttttcataattagaatatattttgctaaattatctaatttgtgaaaatcaatatgaggtttcgtattactacagtgtcgaagtttatgttaatgtaatgtcgctccttaattcagtggcattctgaaagtaattaaggaagaagcaacaacaaaattttgaaataataaaaagaacatgaaataagggaaactaaaaatttcgacatttgttgtctgccgacatttgtgaagcaaatagtttaaatggggtgaaattatttatttttctagatttttcgaatatatgtatatatggggtaaaataataaaacgacatcgaaagtggaaaataaaattatactcaagattgttgaaaagaaaaattggcgagacactaaaggagaaagaagctagattatcattgtaaaaaagtatttatcagtgaaagaaattaaaaaaaaaattagcagcttttaaaatttatatctggtatttatactcctataatcatatattcttgtttgttgtactaagaataattagcaataggatctgttggttatatcatgtttatttttgaggttacttctcgtttttcaatagtgggaacaacttgggataagtgattcgttcgcatcacactttatttttgccgatatttcttttcttttctttatttttggggtaattaaaagtaattggcaaaaattttaagtgtttctagagtagaaaaagtacctttcattgaaaaatatggaagcaattttattttttctaaaaaaaaaacgacaaaagcttctttaattttttttaaacaaacacgttagttcgagctacacactaatgaaggctattcatatttttcatgtttcgaacatgagaggatttattataacatttttgtttctagactttctggtccgaaattttgatttgatagttaaaatttcaaacttttggatataaatttaggttaaggcagtcgaaaattacagatccgataggtttgaagatgacaaagattcaatatgaaatttgccaaagcttgctaaactttaggtaactatccaaactagatatattttatatgggtactacaagcggctacctgatgtcatttttaagaaaataaaataaataagacatttggtggactctaacatttgttgacacttgatggagtgctaataatttttccatgttatatttcatttcatattttttcatattagctattagtcatgatattaaattaaggttaaatatttaatgaaaacaaaattttcaagctaattactttgttttaacccttttataacatagtaaatgatatttaacaagtcatgatagcataacacttaatattgagtttgcatttgctaattgatcttgcattttttagccttcaataatcatatatacttcatacgcatgctttaataatacttatgtagttttttttttttaaaaaaaaatatatactacaagacgtaatatacacgtgcaacgcacgtacactaaaactagtataaataaaaggttgcagtgtttacaactcgtatgtattgtgcatggaggaaaagtcaagaatgcccttgtattccccagcaaaaagaatttatatactataatgtaagctacgaatttaaataaaggaaaaataggaatggtttctccatttgcttttcacaattagtataatgcgatttagctgtgtttgttcgtaaattttaatagtttctttcgcgattaatttcatgtatgacttttgagtttttctacgttactccctccggtccaaaataagtaattttttagctattttcatacagattaaaaaattcaccttttaatattaattagcaatgaaattgaccatattaacatttactatctcttcacataaatactcctaatacatatctccaacactatttactccaagggcaatgtaggagaaaaataattaatttattcttgaaatttggaaaaatcacttattttggactacaaaaaaaaaaagcaaaaaaatcacttattttggatcggggggactaatagttaagttaattaaaaaaaatatttatagtcatattcaagtaaaaacttatttactataattgtaaagtcataaaactatctttaatttatcacgttaaagtaactgaactatgcgtgaattatgcataaattacaaaaaaaaaaaaaaaagtaaaacaaaaaggcacaacctagctgtaaaattgggcacgaaaaactacattttacttttttttgtttagattaagagcatgggaatagtttatcagccaacattatgaggactaagtttgaataagtgtatgttcaaacttaatattgtaaattgtcgttcattgtatgttcttgctcgaatttatttataaaatatttttcttaattaatgaaattttcttttgtagcattaattcttttgaggatagtaggggtgcttatcgggcggataattacgcttaacggttcggcttaacagttatcggattatagatgtagcaatccgctagtcattcaataagacaaaggatggattggtatcgaattgacaattatcggacggttatcgcatggtatatcggctaaaccaaataaataaataaaaaattgacggtcaaatgcatagttcaaattgtctctattagttgtagtagcttttctcgattagaagccaaggacgactgctaatgccattaactacagaaagacgacagtgtcacgaccaatctcgggaggcgcgaccggagctcaatggggtgaacccaactgagcaagccttagcaaacacatcctacctaacccaacatgaagaaggaaaccatactttcattcatttatttagacgaggaaagataatgcgttctacattgctaattcattttaaatcacaacattagaccgtagataggttccaaaatttccatacaattatactttagagaagtaagaattagagttccaacatagttcatagactccttaattacccgtacataacacacacatatgtctacggagcctctaaggatgtaaaagacaagtaagatagtgccagcgacaaggccccagctatacctcaaaaaacaaaaataggagtccacaacaacactagatgcaatataaccccttgaaggagaaaggggattaccaagactttgagaagaaggtactccactacgcgcgatcgacactatctgcgatggagccacctacattcatttaaaaatatagcacccccggcaaaagggacgttagtactgtggaatagtactaatatgtataactaaacaccatctaatcagaaagaactttcatacaatcctacagaaagtcacaagtacaacttaaacactttaaaagatcacaacattatcaaataaaagaatcatgtaattttcacattatttttcatagcctttagtttaaggcacttcatattgttcaacattgttcacaacaccatcgctatcttgagcggagtccaatctcgacctgatcggcttggtcgcctcatttgggacatatacctcaatcacaattcatttttccttttttcggaattcattcacaacaccaccactatcttgagcggagtccgatctcggctaggccgccttgccaacgcgttgttcccttctcattaatcattcgtttcacatataacatttcataggcacttgggaccacaacttatcaaattattcttggcacacgccacattttgtattgttcctaatctcaatattagccttgccatttaggacagtaggtgcacacaaaagcaacttaaattgtaagcatggattaggaataatacaaaatgcggcctagtgccaagaataatgtgataagacttcacataggtggaacaatatattcagctgcaatctcgatttaaagtctaaacattgcataattcatacctttgtccatttcaagtagtccagatagcacgttgatcatgttgagacacattttcacacacacataaggttacaacaccaactcatataaaataacaagcaatgcaataattcatctttaatcttaccatgatcgcacatcaccgatgaagcgcaatttctaaaagacgggattttagccatacatacctcaatatagctttccttaatccttacaaaattccgaaactcttagcacttcgatctattgtgtaagaattaccaattgaaccgagaattagagacgagatcgagattctagcttgttttgagtatattatcaaacactaaaggtgcattgtgatcttacgtcctttttgagagaaatttctatcattttataccccaattgttttctttttagttcattacctcccaataccctaaggtttgatacgcaggcaagaaattcattcttatacccatgaattacctcactaatgaccccttatagctaagtataaaaataagagctgaggtgatgaagtcttacctcttgggatgaagatttagatgccttcacttgattatcttcaatgttctaacaaggatttgtgaatcaatattgataaaaggcacttcccctcgctaagacccttctctctctctctctctctctctctctctctctctctctctctctctctctctctctctctctctctctctctctctctagaagcatcagaaaatatgctcaaaatgagctattacaccggatataacgatagggggtcgggtttaaaatttagaaaattcgagccccgagtcggatctgcgatcgcaaatgttgacatgcggcccacagaatggaccgcaaacatgctcccaaaacttgtacaatctgtctgggtatgcgacagaaatgcgatccgcatacctgttatgcggtcgcataatgcaccgcaaaactgccctttacaaaattccaaggcaattatgcaacgactatacggtccgcataccggttatgcgatcgcataattgaccgcatatttgacctcaaatctgaccaacacgctgactcactttgtagtgactatgcggtccacatacttgatatgcgaccgcattctcgaccgcagaatcgcacttttttgaaaaataaaatttcttaacttcttaatgcagtgatcaactcaaaggtccaaatcgcggctcgcttttatgaattcctaacacctgaccctaacttggcactacgagactcgggtttttcagtgaaaattcacagggcctcacagacagttctattgagaactagaaattagggatttggccatttaggttttagtaatactttatatacataggggtaaaagtataaatataaaaattcttaacaggttaacggtttacccgataaaaaaattgaataatccgctctcaaaatgttaagccgttaattataaaatctcaattcgttcaccatccattacttcgataatccaatatcaataagtcagtaaactttcggttcagttcggttaacaatttcggtttggttttaaacagcacatagcatacgctttagccactatccaaagtaattattcctaagatcatgccttttcattcaaatcttaatccaaaatctgaaagatcttaacaaatcaattcaacaagaaaagcaatttcaaactttgcctttatttaattcttcatcaccaacctaacttagctgacccattccatcaaattcattctgacacgcaaactttttcctaatacgtgtcaactcttttatgaaaccataactatgtacaacgttgatttgacctgtctcctacaattgccacgtgtttcgcgtagaaattcactaatattgacccctctagaaactatttttagcacatctatatatatgtggtcaagaaaatcgtagcggaatcaggatttgaaacttgtgagtttgggattctagttcgtttatgttattgagttctaaattaataatttatacatatttaataaaaaatttaagacaaatatatagtttagattaaaattactgggttcaattgaacccacaaatcctatgctagctccgaacctaaagacaatgatcaaactttcttgtgtattatgtcttggagtcaacaatgtggttattataggggctaggaggaatgataaaattgtcttcgtgtgacttatagatcacaagttcaagcgaaggaagcaaccactactgcttgcttgtattagagtagactgtcaacatcacaccttaggatgcatgcgatccttcctcgaaccttaggtgaacatggaatgcttagagcaccgtattgtcctgccaacggtgatcaatacttaaaaggctcaaacatcatattcaacaaattttaggaggataactcgtcgagtttattgtggacgttgattacctatagttgattataataatttaagggcatttttgaaaagagggttggcgtcgctaagttattattatgaatataaaacaattaaagtattaggtgtccaaccgatatcacgtacctggttttaaatttatgaaattaagttattttaccaccaccaacaacattaatatactcagtatagtctcataaatagggttcagtgacaacagagtgtatgcaaactttatccctaccttaaataagacagattttcctgtataccctctgctcaggaaattaagctattgtaccattattaaaaaatgttgtctctattagtcctattattagaaaagtttcatttttgctgttgacttcctaacggaactcctgaggacaattttctactgcacttaaaaataaatgtttacttttagctagcgtttggccataaatctcaaatttattttgaaaaatttgatttgggtgaagtttgatttgaagataaaaatgtgtttggacatacgttttcaaaacatattttccaactttattttggaaaaatatgctaaaaattctcaagttttaggattttggcccaaattcagttcaatagctgattttgggatttgaaatttgagatttgggatttggccaaaatataggcaaaatttatagccaaacacgagttttgaaattaaatttcaaatttattttgggaaaatgtatggctaaacggggactatgcaccacaaatttcagctaattaatgttaaaggaagagcgagaatccgctacaattgttatatgatctcatcttctacaactgccacatgtaccaattatagatcgacaaatatgataaagatttttagcacgtgtataatagttattggatgaagcaatgatgtgcacatgggaaacatgatacgattagttcattcttggaattttacggccacgccaagttttgttttagacacttctctttgaaatgacaaaattgccattactgtagactagtttaacgcttggtatgaatttagcaatatataagttgatacagggactaaacagtcatttactcttatttgtcgttacgtggcgaggtgttcatattcacattcgagaagtcgcttttatgatcaaacaaataaaaaagcaactattttttctccttaaattttatacctctattagaatccagctctttccatgaaaaatcttccttaaaaattctccttaattcccttctattttctcctcttttttcccattaaaaaatttaaaattagtatctgcttttggagctccggcggttttgttttttccggcggtggcgatgttgtcgctgcaaaccgatcctcggcagtacaatcatcagcagaaacaacagcaaaatcagctactgatgatttctagggttccgccgtatgacggtggcgttaccgtcggtgatcagaggattgattcctcttttccgtttcagtctgagtccgcattgccttccgctagtatcaagtccgagttgtctcgtgaaggttaggtttattccttttgtttttaaatgtgtaaacttcaaaatttgtttggaagaaatttattgattgaaaatcgggacggagtatttgtgttcctacatgtatatgtatttagtactcaatttcatatgaggaagattacaaaattttgtactttttttatttttttattttaaagaattttaatgagataattaatttttaattcggagggatatatgttagtttgtacatagagattttcttaatttgttgcttgattaagggctatgaatttgtttgcaattcaatgttctgtgtttaattggttattttcgcaaaaggatggtcttttttgcataactagtcatcttgattcgcaaaaggaacatttttgcattgtcttgttgtctaattgaagttgctattctcttgtggttcttatgcatagcttatttagctcacgacctggctttaactgggtttcaaagcttaagaatgcctgtaacgagccttcgacaatagtcaggagagcctcaatttaatgatatctcgatatatctcaagcattgttgaggaaagactagtataagcaaatacagatagaagagggaagactccaacttgtctatagcaaataagagattattttctcacctggaagccgccgtactaacaacctatgtcgaattattaaaatctctagcaaccaatgtaggttagctaagaaaacgaaatagaagcaaatgatctgtatagaggtgggattacataatgcaggcataaagtgggggaagtgtgaggtctagcgaaccgctgattcttaaaatgaattttagtatggaattgacctgaataaagtgaagggtatagatagaggattcatccaatggatttgtgattaaagcttcgctaactgatgggtcgatactctacctattatctatgatgacttcgataaaaatttggtgtactttgtctaagtaaagctagtgcactagactgttaaaaactgttactaattccggaggaaaatatcaatgtgtagtaaataggggaacataatattaactccctgctccaaatgtagttttgtattcaggagctagtccaaactttttgtaagtatctgcatcttcttgatgccatcaatataacaccttacttcatcaaaaaggggaacataaacattttatagtatgatagtgttttgtaaaaccttctgaacctaaattactgaatattaatctgttctgtgacactaagaacctaaaggatgtgagagttgagactctgccatgctaccaaccaaaaaaaatatccagaaaaggaataattccttaacaagacatggaaaaagatagagaaaggaaaggggggggggggggggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggggggggttgttgatttgtgccacatgaattagaagatatttaacctggcatcggtagatgtctccgaatagctaagttttgatatatcttaccgattgtatttgctttaggtcgtgcagtcagctgttagccaaatactagtaattgccttatctactgaggatttctattaggataaatttctgacatctctttttattcgacagtagatgaggacgctcttttaactcttgctcatcagaactataaagctgggaactataaacaggcactagagcatagcaaggcagtttatgagagaaatccagggcgcactgataatcttcttctttttggggctatatattatcaggtgagctttcctggatggtccgtacatttgctgtgattcctttatcttgcatttttttaaattttcaataagatttttttaatttttactttattttcgatgagatttgtggatctgaagtaaataatgttaccattactttgttttagttgcacgattttgatatgtgcattgcaaagaatgaagaagccctaaggatcgacccacattttgctgagtgctatggaaatatggcgaatgcttggaaggtatgattctgctaactcatttagtctagaagctgcttcttgtggttttggaagtgagcattgataaagttttgctggtgcaggaaaaaggcaatattgatgttgcaatacgctattacttaattgcaattgaggtttgtatacttcttctgccttacatgaatgtatcgagagattttcatttctgctcttatcaattagaagaaaggtgaaatggttgaagaaaggtcgaagctaatcttgtgatttggaagagtaaccaacaaactccacataagtattaaaaagctccatctgataacttccaatttttacactcggttgcataccatatgtattattgatctagtaaagaattatttctctttctacaagcaaatggttacatgtgatctcgaatagagtaaccaacagcattcatttaagaatttaaatggtaccatgtgataacttgtgaatctttgatgcagaagaatgctagcttagacagttatccttgcctttacttttatgttgggtactgaaagaacattttggttgaggttatgcgggcagttttggagttgcaatggggttgtaggtctaatgcacttgagtttattcacgaaaccttggagcttattgcttgcaattcctttcatctctcaagttcgtgttatttcaaaaagttgcaaatttttaatatatccgtttctctgccatttgtctattcattatctttgattaactaaaacctttttacgtggtagctttctcctatgagatatttattgtttgccaggtttatgctaggttatttgactttatattgtctggttgcagctccgtcccaattttgcggatgcatggtcaaatttagccagcgcatatatgaggaaaggaaggctgaatgaggcagcccagtgttgccgccaggctctagcattaaatccacgtttggtactaaaaaattgaactctataaacgattagttatgtgcttcttgcaattgtattttctttattgactatgattcttttaggttgatgctcacagcaatctcggtaatctgatgaaagcacaaggtctagtccaagaggtaagacagagaggatttcaatccactttgtgctcttctattttgttgcctgagatgggctatttaagttcactagtgcctttaggatggtggttgtgtgtgtgtgtttgggggggggggggggggggggggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggggggtggggggggttcttcaatgctatacatagtttgccttttgtacctgagttggtgcagcatgtggtccagtgttcttttattctggattttttcttgctttgtgcagctttgtgaaaattctctgtgcttattgtaatggctattggcgtatgacgtatcttgttgttatgcttttgcgtgtcgttttccccccgtttctcgatagatatatcctgttgagttccttgtcctttgagtatttcttttttgtttttgggtaggcatacaattgttatgttgaagcactgcgtatacaacctacatttgccatcgcatggtccaatcttgctggcctttttatggaggcaggtgatcttaacagggctttgcagtactacaaggtatggataactttaaatcatagtgtacttgaatttactgatcctagtgttggatttgttttgcatgtgactgcaatcatgtttgatgccctttttgtggtttaatctcctccaggaagcggtcaaacttaaaccgaacttctcagatgcgtatctgaatctgggaaatgtatacaaggtaagcctcatgcattgtgctaattgggtccagtggcttcgagtgtctggacgaggatatggagaaatacaagcatcttctttgcattttccaggctttgggaatgcctcaggaggccattgtgtgttatcagcgtgcgctccaagtacgaccagactatgccatggcgtttggtgagtgccctggttttagtcctgccttaaattcagttcatgatgcataaataaagctgactgtctctgggagactgtttaaacagcatacatctttactcagagatgtctgtgcgcaggatttattacaatatgaaagacactgttttcatcttcagtgcgattttctttggacaccctaataacatattaacacctggatctcctctctgcaggcaacttagctagtgtgtactatgaacaaggaaatatggaaatggcaatacttaactacaggagagctattacttgtgatgctggattcttggaggcatataacaatttggttagatttttatcatattttagtccatgcaaatcctatcttcaccttacatttctttccatttaatgctatatgctctccaaaatgttgcttatagggtaatgctctgaaagatgctggtagagtggaggaagcaattcattgctatcgtgtaagttgtgttccgttgttggttgggcgtgtctttacttttatgttgcttttgtgctgttttttttttaacttttttgatgatgcatgcagcaatgcctctctcttcaacctagccatccgcaagcactgaccaatctgggaaatatttatatggagtggtaaggtttgcttagtcacaaagattctcttcttaactctctcaatcaagtaatgagttgctattcctattctgtaggaacatgatgagcgccgctgcacaatgttataaagcaactttggctgtgacaacagggctctcagctccttttaacaatctagccataatatacaagcaacaggtaaatatttaatctttacttccgtaggacgcttaatttttgagtcagtaaaaaagttttctggaggtttttatacaatgaatatttaagatagtcaagagggattattttatatacaactactaatgcccttcctctgtcaggtttttaactaacatggacttttccttcttatgtgatgtaaatttcagggtaattatgtagaagccatatcttgctacaatgaggtactcaggattgacccaatggcagctgatggactggtcaataggggtaacacatacaaagagattggtagggttaatgaagctgtacaagactacatgcgtgctatttccattaggcctgctatggcagaagctcatgcaaatttggcttcagcttacaaggataggtatgttattaatggttgatggtctcgtttgtttgtgttcctacatgtccactctgattgatcgtaatgttttttttttttttttttttttttttttttttttttttttttttgtgtgtgtagtggcaatgttgaagcagctataaaaagctatagacaagctttgatgctacgctctgacttccctgaagcaacttgtaatcttctccacacgttacaggtatgttcatcctgttcatttacactatttttttgtcttaggtttatcagtgttcatgcactaactactgagaacttgataagcttttcttatatatgtctgaaagcatgaagttaaataacctgtctaatgaactatacttctgcagttcatttgaatttgtctgcttactgcgaggcacacaattcaagccatgttctgtttgcttaatattgatcttaagcttcctattagtactgtttatttacttgtgttatttatctctgttgccagtcgtcttttttgcaaagaaattttgaatttgtcaagcaattatttaaagaagcaactgtgtaaaatttcatgtgcgtcttgtttatgcgaacgtataattggtttcatctaataaaatgtgctttctaggtcaatgacaggttataataagcttaatttgtagcatcacaatagatgactgtttgattgggttatttctgttgcataatcttcccatttatttcattatctgcagtgtgtctgtgattgggataaccgagagaagatgtttactgaagttgagggtatacttagaagacagattaaggtattatagctacttgccgaactgttacaacttacatatttgcttcataggctatatttttatccctgtaatactgactgtattttccttgatggtgtgccctgtcgcgtatgtgacaacttccctttagatgtccgttatcccaagcgttcagcctttccatgcaattgcttaccctcttgatccaatgctggctctagatatcaggtgaggaaatttttttggattaatcacaggaattatgtgaggttgaaactgactgttcttttgcttgttcagttgcaagtatgcccagcactgctctgtgatagcagctcgctactcgcttcctcctttcacccatcctcccccgatgccaattaagggaggtggcaggaacggcaggctgagggttgggtaagtttctataagctgatttatacttggttgcttttcctgaggtcgacatctgctatgggctgtttgtaaacattactgcctgctaataaattttttaaaatgggtctagatatgtgagcagtgatttcggcaaccacccactatcgcatctaatgggttcagtttttgggatgcataacaaagagaatgttgaggttcagacaatttgttgctttttctaatcttttgcaccattcacgacttcgtctcttattcatgctaaatctgctagtacttcttttcctaggtgttctgctatgctttaagtccaaatgatggtacagagtggaggattcgcacccagacagaagcggagcattttattgatgtgtcatccttgtcatctgatgtgatagcgaggatgattaatgaggatcaaatacagatacttatcaatcttaatggttataccaaggtacacattggactcaatccagatcaatcttaattggattttatatttgttttttaagtgttgtttgtctgtcctcaaccatggtggcgcccagttgcttggcccatcaacataaagaaacgaaataaaaggggaaaggagctgccttttcttggaaatagtccacaataaactaataagtcaatgatttcttctgtcttttacttagcttagttgtagacgtgaatctgaactcgaataaatcccgatgagtttttggttagacatggcctcccttttgctgttttgagcaatgagtactataaggagattgcctaatgaaactgcaaacctgtgaacaggtctcatgaggtcacatttgttggaatatgttatatatttgttgtttgacgtgaacattgcacgtgttacatctttcacctgttctaatttcctcattaatgtgcacattctttgctttgccttctttgctgaaaggtgtttttcttttttggtatgactttaattatctaatatttatcatcttcgactttggaatgttgtgttgcagggggcgagaaatgagatatttgccatgcagcctgctccaatccaggtttcatacatggggtttcctggaaccacaggggcaaagtacatagattatttggttacagatgaggtaatctgctagtgactcctttgatattatatttgctgttaaccttttctctttatgggtccttgagtgtaatttccctatatgcagtttgtttcacctacgaagtacgcacatatttactcagaaaagcttgtacatctccctcatagctattttgtcaatgattataagcaagtaagttttcctcactcttaagtttttgatatcaatcgtgttccattcaatccaacaatgaatcaagtatgcctcaatcccaaatagttgaagttggctatatgactcaagtctccttttcgacctaggtcgttcgattcaaatactggataatatttagttatttatttaatttattatgaataaaatatgagcgatttatttttaagaaaaaagagagatctcagcttctatctatgttgaaatcttctggatttatatttttcactgcttttgaatgtcttgctgctgctctttgtagaaaaaccttgatgtgcttgatccaacctgccaaccgaagcgctcagattatggactgcccgaggataaattcatatttgcatgtttcaatcagctctacaaaatggaccctgagatttttataacttggtagttactggattgatttaaattgttcagctgttaccttctcaagcacttgcggtaaacttgtggaattggattgttgcaggtgcaatatcctcaagcgtgtaccgaatagtgctctttggcttctgaggtttccagctgcaggggagatgaggctccgcgcacgtatgtatttcttccacattgtgtgcatttctctaagtttctcttatgaaacttttgaaacttcatatcttgggaacctgtttattagtttatgagaagtctccctaattcagctcatttattccagatgctgctgcacaaggtctgcaaccagaccaaattattttcacagatgttgcaatgaaacaagagcacatcaggcgcagctccttggctgatcttttcctcgacacgtatgaagattaagaagattcagcaccttgctttctaggaatccagttccattcatttcatgttcctgaattttgtgttttttttttttcacttttaggcctctatgcaatgcacataccacaggaacagatgtcctctgggctggtctaccaatgataacccttccccttgagaagatggctactagagttgctggttccctgtgtgtggccacaggacttggggatgagatgattgtcagcaggtaggtgttctagacttgctgtgatatatatatatatatatatatatatacatatatatatatatatatgcaatgcggccagatgcagaagactggcccctatacaaaaaattagatgattaaatgacagaaaaaaatgactgaacagtttcaccatgacacggttcctgtaaagtagtcatatttccttcatatgtatttttttccttagaaacatccattccttgataattcggagagtaggtaggaaggtcctctagaaatcagagacttcttgtacgggggactttttggattccaatttggtgaccttttggaactggcttcctcatttattcatatcgtccactgtatccatactgcttgttttacatgtttttacttgatacccgtcatcatgttgcccgatgagtaactcttagcatgtctcaaggttggtttgtttgaactcatgatggccatgcaagttaatgatgtttgataatgttttctgcttgtaacaattactttagaggacatctgcatatcctacattgacgttcacggtgaatcagagaaaagggttgtccttttactttccatttccttaattctattccttttggttcaatgaatttgatttactttacatgttgcagtatgaaggaatatgaggagaaggcagtgtcattggcactaaatcgtccaaagctccaagatctcacaaatagactcaaggctgtgcgcatgagctgcccgttatttgatacagcacgctgggtgagtgttcgaatgcatcagatttacttattgattctggtgttttgagtgacatggatgcctaaacattgctcattctttctccttgcattttcaggtgaggaatctggaacgttcttactttaagatgtggaatctctattgctctggccagcatcctcagcccttcaaagtgactgagaatgattcagagtttccttttgattgctcgttgtagaaaggaagtcaacatgattttgtagataaaaccaagagaatgtaaactgctatttatatagaagttagattactggattttaggtgtttgttggagttgtaattatgtcataagttttaagcgtatccattcatggtactctcgatgaaagtttattagttgctcaagtgcaagtgaatgtcaagactcacccattgtctagtttggtttgaatttggagatgcacaagagagaaactggagggagaagggtggttggtaggtgtaaaatccaagttgggtggtcaaggagatgtcaggataggtgaatgattgtttttgattgtaagtttttattcatcgacctgtcttgacattttcagctgatttttaaacacactgctatagtatttcctctgaccacgttaaggcagatcaaatttaacgcagattgctataatataccctcgacaacttacggcagatcacaatcttaagagtaagatagtagaactttggctaactttcatgctttgatagcatttttttaacggcagggaagcacaaccgctgaaataacatagatatgtttatgaagtgaagaaccactaattcgagctagcggattcaactctactaaggtagagtgcaaagcaaagcatgtaatgactgcgtaagtttttaatttgcctatttttgtgcatgttgagctgactttgttaggcaagaagatccctacagtctactgatattgacttgttgatagactctacgtcatacatattactatgtactagaaaaaaattataaattccacatccgaccaacaaatagtcatataaaagaaagtacgagtagtagtactattttcggtaaattttgttgcagctcaatcttatatgagctcatgttatgggtctttttaagtcgggagaaattcaaaaatagtcagatttacaactggtcgtttaaaatagcccaatttcaaaagtaatcgaaatttagccactttttatgtaaagataaatctgagcgaaaacattattctaaacccgaaaaattatgcccgtatattatgctggagatccagtataagtatacttaaactcccgcatattatactggagttccaggataagtatgttggaactctaacataatatattggagctcaagtataattatgctggaactcccgcataatatactggagttccagcaagtatatcggtccagcataatatactggagtttggagcactggtgctccagtctcccgtatattatacgggagttagcaaagtataccagtctcgcataatatgttggagttcatacagaggtgcaccgaactcccgtatattatactggaccggtctctattgcagcaaaatagtggctatttttcattgacttggtaaacaccgattatttttgattgaccagtgcgaaacgggctacaccgtgctattaggattaatattggtgtatccgacgacattgaaaatagagtatgatttgagtatgactgttatacagctccttgttgagataaggagaataaataaattaaagagagcagtttatggccataagaaaataaaaacaatctaattaatcaactttttgatatcccttttaggtgtaaaaactctcgctatgtctgtcaaatccatcaggagaataccattgttgggaggagctaaacttttaggttattgtattggtcttgagaaatacattggatacctaataattattaatttagaacctaaaatttttaaaaaaataataaaccacgtaaagaatcctctgccctgtaactcctcgtatgtaacgaaagttaattattaaaaaaactaaaacagcaaagtaccacaagagtgtaacaataacatatgccgttgattgattattgcatcacatagtacaacactaaaaagtcacccaaaatacgttacaaattaaagactacaaaagaagtaacccccccaaaaaaaaaaaaacttaagaaattagattaaattatttaaagcattagttgcattattacttagtagcaggagaaggagaaaagttaagcaattctttctttttctcccaagctttaacaaccaaaacagcatcaaacattttcggagatcctgaggaagtagttgcggagattttaaggtaatatttaataccagaaacaacttgtttttctgcttcaacaacctcagaaaaactcaacaacccattattattattaaccttttgtttttgtttttgcaaatttctgttatactcttcaacacaaaactttcccaaatcttgaatttctttatttgtcttcacatcttggatttgtgttcttccacctagtttttttccacctaaagcatttgatggggttgaagaaactaaggagataatgaagaaaaagaggattaaagagaggatttttgttgtttttgccattggaaaatgggagataattttgatgttggagtttttatgagaaaatggagagttatatagaggtttttttgtttgacacgttatgacttattagggtggtggcaacacgtacgtgatgccgcgtttttgtaaaacaaagtgctgagatagtagaagagaaccgtagtcgtctctaatacgggtaccgaacatcgaataagaaattaaaaaataaataaaaagtcaacacatattataataaagtaaaaattactttttaatccttaatcaaatatttcgggttcgaactttagatatgaaatcgctttattaaaaagtactttacattaatatatcctaatatgaaactttccggcgcccggcatgaatttgaatttaatagcgctccaatataaatacggggcaccatatgaaaaaccacaaaaaaagaatagtaaagtttatatagcgagaggtatttatcttaattcaatagatagaatttagttaaaatacctatttttctttttcaacgagttagtattttaaggagtgtgtcaaaggccaaaagttacttattatagattggagggagtattattagtaaggattaatatactaactctaactttatgcataatatttttgtttgttaaaaggaatgtattttggaattaataaacttgctttctggcaagcattattggcttcttgatcctttggaatttagatatgattgtttctgtgtaaataaatgcttatcttctttggccatctcccctctggttaaaaggtgacagtgcagtatggacaaaggcaatttgcgaatgtcatccatttgtcatttcttctttgttatattgtatggatttgttgtatcccattagcttctcttataggtcattttcattcatgactacaattttctttttttaaccaatcgaatcggtttacgtgcatctcgattaattttatcgaatatttgttagcttctatcagtacaatatcggataactcaatgtcacaatccggaatttctactttcgggagttgtgatggcgcctactcgtagaagctaggcaagccacgctcttatattcttttcctttattttaaaccatttttaacaaaaataacaagaagagtccaataattaataactgcggaaacatgaaaatttatgcggaagatttaagttagataaactgaacaataacgcggaattcaccatacatctctacccaaggactggtgtcacatcactcacagactactaagaatactaaatacaattgtttgaaaagaaatgtaaactgtttgtctcgaaatacatgagataacatgtggaaataaaagatagatgagactctgggcctgcggacggtcagcaaggctacctcggtatctttggactgaaagctcgcttcgggctactgctactgctcaaatgctgctccaaaactgggatctgtgcaaaagagcacagagcgtagcatcatcataaccgaccccatgtgctggtaagtgtctggcctaaccccggcgagatagtgacgaggctaggaccagactccagatacacctgtgcagttatataatatacgacaaagaaataacaggaaataacaagcaaaactagggaggggaaaacatgctctggggatagcaaatagaaataaaatatcaagggcaaaagagtaaacatctacaatctagcttctaacacagaataaaggaaataagacaactttcatgttcaactcatcttgttgcaggcgtacaacccgatcccatttcatcatgacccgtgataggcatactgcccgttcccatttcaatcaatatcgtgcggtaggcgtacctgatgttccagacgtcaataccacacaagaggggggggggggatgatttgtgtggtacccaattttcgatctagaagaacctggttcttctaggtgttctaatagctactgtttgtggaattaaaagtacataaattaaagaacacagggatttttacgtgaaaaacacctggctcaaaaggtgaaaaaaaccacgacctactactcaataggattttcccaaacttccactaaaatcaatgagccaaaacaacatttacaaaactcttgtaaacctaaggattaactctaatcccagtgtggcacacagcctcaactgctgcgacactttcaagttaactctaacttgaatacacaaagtacctaatacaattgcttctatgaaactagaataagaataaacacaatggaactggttcttctatctcgttcaagtagcttcaggagtgcacacttaaatctcacataaattgcttgcaaaattgccttgctattttgctctcaatttagtttaacttctgcatatgcgcaatacctgtaaaagagaacaaactcagttatttattgagttagtaatcagagtttgattgagactcaattgctgatccttagatgaatttgagtccttgaacaatacaaactccaacccttatccttgatccggacttgttctcttctcataaggagactgttctcgttatcccatatgcaatcttttcgatcagttcagaagatattattgcttgatctctaagtcatatcttcctcacgtgcatctcatatgcaaaagttggttaacactgtgtctcaccagatggaccaggtccatcactgagttcatttgtcattcttcaaaacttcacctgaacttgggccaacaaattccccatttttgatgatgataaattctgtgcttttactgatcagagaacctgtggaactcagctaaattatcaacacttaaaattttttaactcatcattaaaggggccagatttaattaggtcataaacatcactgttcagagaatagagttaagcacaatatctttccccttttggcatcatcgaaaagttgcataaaaaatgtgaatcctagaatttcaattattactcatggccactggggcaactgcaagtgaaagcatgctttagttaatcaaaaatcaacttgacaagaataactattaagatcagaattatcacaaaataagagaaatgcaaattgtcattgataggcagtgcttctacataacagtccacaaaaagaaagaacaaaaacaaccaaccatgagcaaaaacaagaaaaaaccctaatctgggtcactaggggattactagactggttcaaaaacaggacaaggagacctaaggctttgaggaactagagggtttggattggagaaggttgagcattgtttggagcatccctgcactcttttccttttctttagctagctcagctctcagcccattcctcttatcttccagctcagcaacacgagcctgaagcctatcaattttagcatcctttgtcccacactcttgaacaaaggccctaaccttgctattcactggagtcttcacttatgaaccaggttcaacagggcctacactgaggagatagtcacaagcctggagggttttgatcccaaagtactccttactggaggccatttcccatttcttcaaaggaacgttcagcctgtccagtacagttgtcagaatgaatccataaggagtagcatgagcctttgagccattgatgactctgtccagaagtttgacaatgaaagcaggccagctaatctgctttcccctcacaaggcattccatgaaaaccaggtccatgtaatttgcagtatgcctcctctcctgtctaggcaacaggcacttgttcacaaattcaaagagcactttatgctctgacttcatctcactcttttgaacaaatcttgcctcaagaacatcttcagcatcctttgtatcacagaagttcctggtgatttggagtgcagtaggcagatcatttagacaaggccacctttgcctggtgtaatcatcatagccctcatttggaatgtctagaattctgcccaattcaggtgcatcaaattgcaccttcactcctttcactacactagttactagcccatttaccatagagccatttgccatgaattcaatcagctctcttctgactagtcttccatccatctgaaggaccatgtacttccacctttgtgcatgtagtgcagccaccaatcttactatgcctggatcctccaagtctttcaacaatctacccttcagaatcttccttctgccaaagatgacaaacctgtcttgttctttttcagactcctcttcttcatttactttcctctccactccactcttcatcccactcttcagtaatttttacttgttttcccttcacaactgacctagttcttttggccaaagagggttcaacaggtacaaatttagaaggcttctttgcagaagtcctggttccttttgatttagcagtgggaaccttcacagtcgtacccctctattgatggaccagtttcatctcatcctcctcttcttcagcagcctcagaactttcaaccacttttgcttttcccttttctttcttcttcttcttcttgctttcctctagtgatttttgcagttctgcttcactttgcttgactctgctccttgtggctcttcccctaggtacagaaggagcagcagacttgggagatgatactttgctcttctttgttggtttagaagcaactggggtcctttgtgaggaagccttgcgtttctttgggtcatagctggccccaaccttctttagcatatctgccaaggtttcctccacagatgaaccaggctcatcttgttgctcactcaaattaacaagaccttagcagcttcaccagaaccgcttccccctgacttgatgccaccctcttatacactaccacagatagcaagaacctttcctttctttttctttctcctcctactagactcagccccttcaacattcttgacagaacccaccaatataaacctactttcttcccttctaacacatcagaaaataccagacaagtgtttacctcacctgggatttcttgactcttgtcattgtcagaagacccaggttcttctctttcactagtagaaatgaatttctcaaacttagaacttgagtcagattcttttgctggagcctctttcttttttgctagcctgtaatctttcatttaagactcttttcaaagaaccagatgctatagttttctggctaacatcttctgccggcgaaatttagattttggggattcactaggaggtgttgatgatgaagtgttaggggatactggtgggggagttccaggattatcttgagggttagtcatggcagagtatttttgaaaatcttttgggaatttaggagaagaaaggggatgatcagaaattaggagagatgaatgacggttatgagtgatgagagttggtgtggtaggtatttaaagagggatcatgattaaggcagtaacgacagctttttcagtagtcaattaggagtctaatcaaattagaattcctgtcttcttagagattaataagcgatgctaatttttaggaaaaaatcccattttagttagactcctagggtaatgaaactggttcaatgctcaacggataaattttttggaagtttggtgtaactaggacttctgctcatgattggtaattttatatttctaattttgcaaagtatagaaacatacctgaaatttctcatgagcatatattgatgaaccaggttctttaagtaaaacttctcttgatcttgcctcaaatgtcagaatagaaaactttgtaagagattagtgagtcatataaacacatgccacatgagtatactaattaaagtatgagactgagtaagaattagtctagatatttacattgaattaagaactcctaacaaaaaaaaatgttttttttcattgtgcattctgaactggacctttttaggtgatcttaatcatccttaattccaatatgttcctttcaaagttttctttacttagtgctttagtgaagatttcagctatttgtttatcagtagcacagaattctatggagattaaccctttcacatagttatctcttaagaagtggtgtctaacatctatgtgcttagtcctttaatgatgaacaaggttctttgtcatacttatagcactagtgttatcatagaatattggtatacatcccacttcaattccaaaatctaccagctgttgtttaatccatatcaattgagcacaacatgaagcagcaacaacatattcagcttcagcagtagagagagctaccgagttttgttttttggtagcccatgatacaagataagaacccaggaaatgtgccatacctgaggtgctcttcctatccacaagaaaacctgcataatcagcatcagcatatccaattaagtcaaaattactacctttgggataccaaagaaacaaatcagtggtgcatttcaaatatctcaatatccttttgacacctgtcaagtgtgactcttttagatttgcctggaaacgagcacagagccctacactaaaaacaatgtcaggtctgctggcagtaagatacaaaagtgaaccaatcatacccctatacaacttctgatcaactaatgaaccaggttcatcaacatctaatttagtggcagttgcaataagtgtatctatttctttggaatcttccattttaaacttatgattagtttttttgtataattctgctgatggatcatggtttcatttggactttgtttgatctgcaagcctaagaagaagttaagttcacccatcatactcatttcaaactcacttcccattagttttacaaagtccttactcaacctatctgtagtggccccaaatattatgttatcaacatatatttgtacagcaagaagatctttatctttttcccttaggaacaaagtgctgtcaattttacctcttttgtactcatgctccagtaggaattttgacagtcgttcataccaagctcttggtgcctgcttgagcccatatagagccttatctagcttgtacacatgctcagggctctcttcgctttcaaatcctgggggttgtttcataaacacttcttccttgaggtagccatttaggaaggcacttttgacatccatctgatgaagagtgaattccatatgtgctgcaaagtttataagaagcctgattgcctctagtctagcaactggagcaaaagtctcatcatagtcaatgccttcctcttgactgtagccttgaagcaccagccttgccttatttcttgtaactgttccatctttatcaagtttgttcctgaagacccattttgtcccaatgactgatctgtccttgggtcttggaaccaaatgccagacttgacttctttcaaattgattgagttcatcctgcatagcattgacccaatttgcatcctgcaaagcctcaacactatttttgggttcaatgagggttagaaaggcatcaaatgcacacagattctttagttgagatctagttttgactccagatgttggatcattaatgatgttctcaatgggatgagaacttaggtacttgtgagacttcccaaccaactggttcctgttacatgtttcttcattgttctgctgctgaggaacaggttcaaggacaggttctttcagagaattttgttcaatttctctcagattagttctccctatcaggttgccttgagtggaagaacctgttccatcacctgttccttcctttaatgccactttgacttgtactgtaacttcagtcaattgtttcactagtccaatggcttcatcttcatgttcctgtctctcagaaagaatgttagtttcatcaaatacaacatgtacactttcttctacacacagagttcttttattaaacactttatatgctttgctatgtgaagaatatcccaagaatactccctcatcacttctgggatcaaacttacctagagagtctttaccattattatgcacgtagcactcgcaaccaaaatccctaagatgggatatgtttggttttctccctttaagtaactcatagggagttttctctacaagaggtctagtcatgtatctattgattatgtagcatgcagtgtttacagcctctgcccagaagctgtgaggtagtttactagaaagaagcatagtctttgccatatcctcaagagtcctgttcttcatttcaaccaccccattttgctgaggggtcctaggagcagagaagttatgatctataccattttcatcacaaaattcagcaaactttgcattttcaaattcagttccatgatcagacctaatggatgcaagttgatttcctaattgtttctgggttttttctaacaaaagcagtgaacatttcaaatgcttcatctttcgaagttagaaacagtacccaggtaaaactagaataatcatcaacaagtgccattacatatttctttccacctctgctcatggttctcattggaccacaaagatccatatgaaccagttccaacgtcttggatgtacttaccattttcttgggtttgaaggatgaccttacctgcttccctcttgcacatgcctcacaaactttatcttcgttgaacttgatattaggtagccctatcaccaagtccttggagactaatttgtttagttgatttagactagcatgaccaagtattttgtgccacaggaggggatcattaactaacacacttaagcaagtgagttcgttttcagaaagagttgacaaatctacaatgtaaatattgttaactctttttccctgcaaaacaatcttgtcagtagtaaggttaatcacaaagcatttggtataggtgaaagctacaagattacctctgtcacacagttgtgacacatttatcaggctatattttaagccatctatcaaatatacattctcaatggaatgagagcctgtctttcctacctttccaaccccaatgatctcacctttctttccatttccaaaggagacattacctccttttaggttctcaagtgaaaggaactggtccttgttcccagtcatatgttttgagtagccactatccatgtaccatatttggctactccctttcacttggacctgcaaaaagaaatcatgggttattcttaggaatccaaactagtttgggtccctttctatggacaaaaggatgaattagattttttcttacccaaccaggcaacttgtatttctcttgaacaaaagctttgttcttttgactggccttttcttttgcattgcattcatttttataatggccagtcttaccacagtgtgtgtagatcttactctcaggaagtgtgaggtacttatttttggggtcccattttggagcttgagtcctataaccaagtcctctcttgttgctgctgtgatgctcttgcaaccaggagagtgcatcagaagccttgttccatttgcatgttctgtctagttcatgtttcccctttcctaaatctacttttaaggctttgatcaattcatcgttcttatacagttcatctttcatttttcctaggttttcttctaggttgagaaatgagtgatcagctttcttctttcctgttcctaatttcagttttaggttttcagaactgagttctaggacactattttcaagttcaagaacttggttcttcaacttagcatttttgttgtcactttcatcagccctagactctaaaattttgcattttgcttctacgataacacattccctagacagaacttccttctcaatgtttactatttcagactcatcaatgaagtctaataataactcaaccagcctttctttagacaaaaatttaatcttgtctttgagatgtaggatacttacctcctgttcatcctctgattctccgatggccataagagcttgctcatcttctgagtcctcatctgaggtttctccccaagcagcaaccatagtttttgttgatcctttgtttcttcttggttgaacctattccttcttcctattccttctgtctgccctttctttcttccactcaatttcccattgaggacagttcttgatcatgtgatcagtctttccacacttgaagcacccatcatttctctgtttctcaggagccctaggttagttgaaggttgttcctcttgcctttcctctcatcagatactttttgaaatccctagtgatcatggccatttcatcatcttctagatctgatccttctgagatcctgagagccagacttctttattacttgggagcatccaccttcatagtctgccttctcagttcataggcagtgagattcctaatcaattcatccagttttagggtagaagtattcttagattcctgaatagctgtgattttgctttcccaagcaactggcagaactcttgttaagatcttctcaaccttgtcttcttccaagataatcctcccaagagacttaagttcatttgtcagtgtagtgaacctagtgtacatctcttggatggtttctccatccttcatagtaaaattctcatattgagaatacaacagtgttcctctggacctcttcacttgaggtgttccttcatgggccacttgtagggtgtcccagatttccttagcagaattgcaactttgaattctgctgtactcatctagaccaagtccacatactagccatttcttggccttagcattcttttcccacttctttaagtcttcagcagtgcagtcagctctagtctttggaacctccactccttcagcagtcttctttgttgtggctaaaggaacatcagtgatgatgtcccaaatctcataatcctcttccataatgtgatctctcattctattcttccaccaggagtagtagagaccattgaagagtggaggcctagcagtggattgcccttcccagttaccaggtggtgcactcatgttttatctttcctaaggtgttagcctcttcaaggataacctgctttgatactgattgatgttccagacgtcaataccacacaagaggggggggggtgatttgtgtggtacccaattttcgatctagaagaacctggttcttctaggtgttctaagagctactatttacggaattagaagtacaaaaattaaagaacacagagatttttacgtggaaaacacctggctcaaaaggtgaaaaaaaaccacgacctactactcagtaggattttccgaaacttccactaaaatcaatgaaccaaaacagcatttacaaaactcttgtaaacctaataattatctctaatcccagtgtggcacacaacctcaactactgcgacactttcaagttaactctaacttgaatacacaaagtacctaatacaattgcttctatgaaagctgaaaggtacaaattcaaaatcacctactacacttgaactagaataagaataaacacaatggaactggttcttctatctcgttcaagtagcttcaggagtgcacacttaaatctcacataaattgcttgcaaaattgccttgctcttttgctctcaatttagtttaacttctgcgtatgtgcaatacctgtaaaagagaacagactcagttatttattgagttagtaatcaaagtttgattgagatcaattgctgatccttagacgaatttgagtccttgaacaatacaaactccaacccttatcattgattcggattgtgttctcttctcataaggagactgttctccttatcccatatgcaatcttttcgatcagttcagaagatattgttgcttgatatctaagtcatatcttcctcacgtgcatctcatatacaaaggttgattaacactgtgtctcaccagatggaccaggtccatcactgaggtcatttgtcattcttcaaaacttcaattgaacttgggccaacagtaccactcgctcccatttcaatatcatttgtggtaggcgtaccactcgctcccatctcttgcaatatctcgtggtaggcataccacccactcccattcctttcaatatcttatggtaggcgtaccacccgctcctatttctttcaacacaatacacaataaaatcccgacaagggaaagtgaatattaaaccaactattttggcaagggaggtccaactataaccaatcctattcaatttctacttagcatagctaaaaccaatactcagtatcaaggctcatcaaacaagtcttttatagaatcaattaagagtacacaattatcaatttaagacccacggtcatgctcgacaccaacatatggatactcgccaccatgcccatacgtcatactcaacacctaacaagtagcaattatgactcaactcctaatccctcaagccaaagttagaccgaacacttacctcaacttcctcggccgaatcaatccacaataaccgctttccctctcgaatttggctccaactcaatcaaatctatgcaataacgactttatagtatcaatataagctaaacaaatcaaacccaatgcctaaatatagattcccaatctttcttcccaaattacaaaaattgaccccggggccgcttggtcgaaacacgaggttcggaccaaattcataccacccattttcccacgagcccgaatatataatttgtttcaaaattcgaccccaaaatgacgtctaaataaagaaaatataaaaagccctaattctaccaatttctaccttaaactacatgatttaggcctaggatttcaatagatggtgaaggaaatgaaaggaaacaagtaaagcattactaacccatagagtataggtgaagaatcgcttcaaaaatcgccccaagaggtgtggagaagaaagagatgaaattttaaagttggaccgaaatgattctgtttcagaacttaaaaatcgctggctgaaatttaccctacgcgatcgcgacaggagggtcgcgttcgtgaagggtagaggctgacaaccatcgcgttcgcgagtggagtagtgcgaacgcgaaaaggaaaaatactggggtctaaggaattggcctatgcgaacgcgtgaggctattcgcgaatgcatagaaggagggtcgtggacttacggaatgcgagatcagttacgggaacgcaaaggaggaagacctaaggcatcgcgaacgcggaaggggggcgcgaacgcaaagaagaaaaatgctgaggtcctgttgtagattttctgcaacatttactaagttcaaaatcatcccgaacccctccaaaaacactcccgagccctcggagctcctaaccaatcacacgtactaactcaatcacatcatacgaacttaattgtgcgatcaaatcgccaaaataacataaaagtgaggaatcaaacctcaaaaccattactttttcatcaaatttcataactttcaaacttagagttttaggtccgatacacgtcaaatgacgtccgatttcaaccaaatttcacagaaacgtcttaaaacacatataagacctgtaccgggcgccggaaccaaaatacgggtctgataccaacacgttctaatccattttcatttcaattttccttaataatttcagaaaaataatttcttttaaaaattcatttctcgagctcgggacctcgaatttcaatttggggcacacacccgagtcccatatctttctacggaccctccgaaattgtcaaatcatgggtctgggcccgtttacccaaaatattaaccaaagtcaactttactcattttaataccaaattttagcattttgtttatagaatttcacatacaagctttctggctactcgcccgaactacacacgcaaatcgaggcaactaaaaattaggttttcaaggcctcaagaagcatggaaagagagagaaaataggtgatgaccctttgggtcgtcacattctccacctctaaaacaaccgtttgtcctcgaacggacaaaagaaagaagtacctgagtcgggaaatagatgaggatagcggctccgcatattggactcggactcccaggtcgatgcctcaagaggctgacctcctcactgaacacgcactgaagcaaaactcttcgacctcaactattgaacctgctggtctaaaatagccaccggatcctcctcataagacagatccttgtccaactggacagtgctgaaatctagcacgtgggatggatcaccgtgatacttccgaagcatggacacgtgaaacactggatgcacggttgacaagctcggcggcaaggcaagtctataagccatatctcccacacgatcgagaatatcaaatggaccgatgaacatagggctaagcttgccctttcttccgaatctcatcacgtccttcataggcgacactcggagtaatacccactcaccaaccataaaagccacatctcgaaccttgcggtctgcataactcttctgcttggactgatctgtacgaagcatatcctgaataattctgaacttatccaaggcctcctgaaccagatccgtacccaataatcgagcctctaccggctcaaactatccgactggagaccgacatcgcctgccatacaacacctcatatggagccttctgaatgctggactagtagctgttgttgtaggcgaactctgctaaaggcaaaaactggtcccacgagcctccaaaatcaatgacacaagctcggagcatatcctctagaatctgaatagtcctttcggactgaccgtccgtctggggatgaaatgctgtactcaactcaacctgggtgcccaactctcgctggactgctttccagaagcgcgaggtaaactacgtaccccaatccgaaatgatagataccagcaccccatgaaggcgaacaatctccccgatgtagatctcagctaatctccctgatgaataggtggctgcaataggaacaaaatgcgctgacttggtcagcctatcaacaatgacccaaactgcatcgaacttcttccgagtcattggaagtccagtaatgaaatccatggtaattctctcccacttccactcaagaagctcaatcatctgaaacaatccaccaggcctctgatgctcatacttaacctgctgacagttcaaacatcgagccacatatgcatctatatctttcttcattctacgccaccaatagtgctgcctcagatcctgatacatcttcgcggcgcccgggtgaatagaataccgggaactatgagcctccgctaagatcaactctcaaatcctatcaacattgggcacacaaacttgcccctgcaatctcaaaacaccatcatcatttaaggtcaccttcttggcacctccacgctgcaccgtgtctctcaggacacacaaatggggatcatcaaactgccgatcacggatgcgctccaatagagaagaacgagtgaccgtgcaagctaacactctacttggctcagaaatatccaatctcacaagtcgattggccaaggcctgaacatccaaagcaagcggtctctggatgaccagcatataagcaagactccccatgctggctgacttcatactcaatgcatcggccaccacattggccttccccgagtgatacaagatagtaacatcataatctttcaacaactccaaccaccttctctgcctcaaattcaactccttttgcttgaacagatactgaagactcttgtgatcagtgtacacctcacacgtcacaccatatagataatgcctccaaatcttcaatgcatgaacgatggatgccaactctaaatcatgaaccggataattcttctcgtggatctttaactgcctcgaagcataggcaatgactcttccatcctgcatcaatactgcaccaagcccaatacgggaaacatcacaatagactatataaggccctgaacttgtgggcaaaaccaatatcggtaccgtagtcagagctgtcttgagcttctgaaagcttgcctcacacttatgtgaccgtctgaactgggcacccttctgggtcaacctggtcatcggggctacaatagacaagaacccctctacgaaccgacgatagtagcccgataaccccaagaaacgccgaatctctgtagctgaagttggtcgaggccagttcttgactgcctctatcttattcgggtccacctgaataccccctgctgatataacgtgacctagaaatgcaactgaactcaaccagaactcacacttcgagtacttagcatataactgactatccttcagagtctaaagaaccactctgaggtgatgctcgtgctcctcatggctgcgagagtatatcagaatatcatcaataaagactatcacgaacaagtccaaataagtcctgaacactcggttcatcaactccataaatgtcgctggggcatcggtcaacccgaacaacatgaccaataactcataatgcccgtaccgagtgcggaatgctatcttagggacatcggatgccctaaccctcaactaaatggtggccaggtctcaagtctatctttgaaaataccttggcaccctgaagctgatcgaacaaatcctaaatcctcgacagtggatacttattcttgatcgtaactttgttcaattgccggtagtcaatgcacatcctcatcgaaccaccctttttcttcacaaataacactagggcacccccacggcgaaatgctgggtctaatgaaactcttctcaagcaaatcctgcaactgctcattaaactctttcaactgtagcggggccacgcgatacggcgagatagaaatgggccgagtgcccggagctagattaataaaaaaagtcgatatccccgtcgagcggcatacccggtaggtctgaaaggaaaaccttaagggactcccgaacaataggtacgaatcaatagaagggacctctgcactagaatcgcgaacatacgccagataagctaaacaccccttctcgaccatgcgtcgagctttcacatatgagataacactacgagtggtatgaactgtggtccctctctactccaaacggggcaaatctggtaaagctaaggtcacggtcttggcatggcaatccaagataacatcatacagagacaaccaatccatcctgaatataacgtcgaaatccaccatgtctaagagcaacacatcaacacaggtctcaagactcccaaactctacaacacaagaacggtgaactcggtcgaccacaatggaatcacccaccggtatagacacataaacaagagtactcaatgcatcactaggcatgaccagatacggtgcaaaataagatgacacatacgaatacgtagacccagggtcaaatagcactgaagcatctttatcacaaatcagaatagtacctataatgtctgcatctgaagactcagcctctgacttggctgctagctggcctccacctctggcggcctgagctccacctctatgacctctacctccacctctaacacccctgccaccactggctgggtaagccgtggatcctctggtgcctgaatcctagtacgagaactctgatgctgagagctgctcgaagctcgagggaaaaatctgataatgtgcctcgggttaccacaaacatggcaagacctcgactgctacggctgagcacccctcagcctcgggcaagatctcctaagatgaccatactcgccacattcataacatccacacgattgctgtagctgcggaaacagaggctgaccttgtcgacctgaatgaccacctaaagtaccatgagtgacctgaagagctgactgaaagggcctaggaggatggcctctacaataagaacctctacctccagatgaggtaccactgaatctacctgcatgacgtggcctcttatccgacccatgaccacctccctgtttgaaccactggaacttgaacctggggagctacctgctctagagtacacgtagcaagagtctgaacccttcctccagtttgaaaagtggctggtgctactggaagcaaacccgctcgaatgacactctccatgaagcctaccaatcggactagagtgtcctgaagaattggggtggcaatgaacccctctgggacctaagctgggcccaccgggactgttggggctggagcctcctcctcaaaatcaacctgaggctccgccactggggctgctgctggggactcagactgctgagcggtagatgaaaaagcgtgtattctcgccatctgcaaaagaatagagtagaaattcaatcggtgtttcgaaaaatagaaccgcaagacaagaaagaacaaatgtgaagtttttctaactctgtagccactgggggataaatacagacgtctccgtatcgatccctcagactctaccaagtttgtccgtgagttgtgagacctatgtaacctagtgctctgataccaacttgtcacgacccggaatttccaccttcgggagtcgtgatggcgcctacttgtagaaactaggcaagccatgctcttatattcttctcctttattttaaactatttaaaacaaaaataacgacaagagttcaataattaacaactgcggaaacatgaaaatttatgtggaagatttaagttagataaactgaacaataacgcgaaattcaccatacatctcgacccaaggactggtgttacatcactcacagactactaagaatactacatacaattgtttgaaaagaaatataaactgtttgtctcgaaatacatgagataacaggcggaaataaaagatagatgagactccgggcctgcgcatggtcagcaaggctacctcggtgtctctggactgaaagctcgctctcgggctactgctgctgctcaaatgttgctccaacaccgggatctgtgcaaaagggcacagagtgtagcatcagcacaatcgaccccatgtgctggtaagtgtctggcctaaccccgacgaggtagtgacgaggctaagaccagactccagataaacctgtgcagttatataatatacggcaaagaaataacaggaaataacaagcaaaactagggtggggaaaacatgctctggggatagcaaatagaaaaaaaatatcaggggtaaaagagtaaacatctataatctagcttctaacacaaaataaaggaaataagacaacttttatgttcaactcatcttgttgcaggcatgcaacccgatcccatttcatcatgacccatggtaggcgtaccacccgttccgatttcaatcaatatcttgtggtagacgtaccactcactccaatttcaatatcatttgtggtaggcgtaccactcgctcccatttcaatatcatttgtggtaggggtaccactcgctctcatttcaatatcatttgtggtaggcgtaccactcgctcccatttcaatatcatttgtggtaggcgtaccactcactcccatctctttcaatatctcgtggtacgtgtaccacccgctcccattcctttcaatatcttgtggtaggtgtaccacccactcctatttctttcaacacaatacacaatataatgccggcaaggaaaaatgaatattaaatcaactatcccggcaatggaggtccagctataaccaatcctattcaatttttacttagcacagctaaaaccaatactcagtatcaatgctcaccaaacaagtcttttatagaatcaattaagagtatacaattatcaatttaagacccacggccatgatcgacaccaacatatggatactcgtcaccatgcccatacgtcgtactcaacacctaacaagtagcaattatgactcaactcctaatccctcaagctaaagttagaccgaacacttacctcaacttccacggccgaatcaatccacaacaaccgctttccctctcgaattcggctccaactcaatcaaatctatgcaataacgactttatagtatcaatataagctaaacaaatcaaacccaatacctaaatatagattcccaagctttcttcccaaaattccaaaaatcgaccccgggcccgcttggtcgaaacacgaggttcggaccaaattcatactactcattcccccacaagcccgaatatacaatttgtttccaaattcgaccccaaaacgaggttgaaatcaagaaaatataaaaagccctaattctacccatttcccccaatttctacctttaactacatgatttaggcctaggatttcaatagatgttgaaggaaatgaaagaaaactattaaaggattactaacccacagagtttaggtgaagaatcgcttcaaaaatcgccccaagaggtgtggagaagaaagagtaatgaaattttgaagttggcccgaaatgattctgtttcggaacttaaaaatcgctgggtgaaatttaccctacgcgttcacgataggagcgtcgcattctcgaagggtagaggctgaaaaccatcgcgttcgcgagtggagtagtgcgaacgcgaagaggaaaaatactagggtctaaggaattggcctatgcgaatgcgtgaggccattcgcgaacgcgtagaaggagggccatggacttacacgaacgcaagatcagttacgcgaacgagaagaaggaagacataaggcatcgcgaatgaggaagggggggcgcgaacgcgaagaagaaaaatgttgagggcctgttgcagattttctgcaacatttactaagttcaaaatcaccccgaacccctccaaaaacactcccgagccttcggggctcctaaccgatcacacacactaactcaaccacatcctacgaacttaaccgtgcgatcaaatcgccaaaataacataaaaaacgaggaatcaaacctcaaaatcattactttttcatcaaacttcataactctcaaacttagagttttaggtccaaaacacgtcaaatgacgtccgatttcaaccaaatttcacagaaacatcttaaaatgcatataagacatgtaccggacgccggaaccaaaatacggggccgataccaacactttttaatccattttcatttcaaatttccttaataatttcataaaaataattttttttaaaaattcatttctcgggctccggacctcggatttcgattccgggcacacgtccgagtcccatatttttctacggaccctccgggaccgtcaaatcacgggtccgggtccgtttacccaaaatgttgaccagagtcaatattactcattttaataccaaatttaagcattttgttttacagaatttcacatacaagcttttcggctactcgccagaagtgcgcacgcaaattgaggcaactaaaaatgaggtttcaaggcctcggaagcacggaaagggagagaaaacaggtgatgaccctttgggtcgtcacactcaatcaataaaaaaaaagatagtttggtggacaatgcatctcgtatttacgtaggattaagagaagagatgcaccttaagggctcatttgctatgaaggataaggaataattaattccgggactaaatttaagaagagtttatcccatatttggttggtagaaaactgcggtataagatgagttatctcgggattgtagtatctttttatccccatggaaaggtgaaataactaattccgagataattaatcctgggataacttctttccaaccaaacgactcctaaggaatgtgatttggagagtttaccctaacacaaacattaatgactgtttctatggcttgaattcgtaatttataagttacacgaagacaattaaatcaatcaagacttagataaatgaaataatctaatatatttatctccatcaaaatttgaatattagatctcataaattttcatcgattttactgactactatgttacaacattgggtgcattatgactacaatatttaggtacataataaataaatggaattttagtactatatattttttcagaatattccaactatcgctgtttcagtactttgttacttgaggtactgcaattaaagataatttaatccacttgccatatttcactacggctgcctaaactattttaatttctttttttttcttaacaaaagagagtaaaatccaattagactatagaatttcaaaacttatgatattaccgttcgaattatgatactttgatcgttggtgtaaaaaagatcaaatgatatctgtttggctaaaagtttaaggaatgctttaagctcaaaaacaatcaatgtttctaaatgatgggtaaatcggaaccaaatataataagctttaagagataataatgatagtatattcgataacttgagcaagatagagatagagaaaatagagagagagagagagttgtatattcttagttaaaagatacacatgaatcttacaaagagggcgaagtctcctttatatactaggagcctctcctcgaaatactgaaagtgaaatacaatggttggtggcctcagggtacggatgtgtcagagcctgcaacgtcgccgtcacaggtcttgtcaccgagttgctttatcccaacggcattcttgcttgggccgtccatactcaagcaggcttagtcaaggtcgtccccaccaatgccgttcttatcagggacgttcccatcaaggccgctccttcatggacgaggacgcctacacggctttgaggtcgtgggtaaccgaatttgcccaatacagatagtccctccgtttgttggggacgtagtcaaataaagtctctaacaaacggaccaatggacgtagtccttattgaaacaaggccgttgacatgttgcgttctttttgggtttcccctttttgatgacgtcatcgatcacgtgcgtgatcattaccttctactttcgaggcggttcaggtcatgaagtgacgttttggtttcccgcgtcagaacttttttgagctgcgccttttcgattcccgtgcacttttcttgtataaataggagaggggttaaaaattgcccaactttcgaacccttgcaacaaattttctttcgatcttatttccttttctttctcgtatatctcaattcatctgatattaccgctttcgggaatctaacctcacatctccaggatactttaaacctcttttttctgttatggcgaaacgtggtcgcaatcacgaaagggcagggggtgacgccccttttagggtttcttcttcttctgatagtggagaagatgaggctggggagtcgttcgtccctctatcaccgtccaacgtgcttcctcggagttcgaagaaacgaaaggacttcaataccactagcaaggccttcccttgggagcttagtgagataacgccgtctcgcttggacgatctcaggacgacttttaatattcccgaccaggtggagatagttcctgctgggacggattacgccaatgtgcatcgacccggctactgcgtgttttatgagtacgctctccgaatagggtatagttttccgatcaactcactggcggaggagctctgccgcttttacggggtgtgcccgtcccaactgactccatacgtgttgaaggtgtgtcgaatcctcaccacttatgcggccaaagccaatgtggaggttaccgtccatcatcttttgcagatgtggaaggccagcaccatgagaggcaccatgctccaactggtgcgtcgtgctaagcagagtttcgtagtgcgatcggatgacagaaccaatcgccaattttggaagaagttcttttatgttcgtactgaacatctggtgtctaacccggtagattttcctgaggagtgggatactgaacgtaagcagccctgcatgtgcctttgatggcagtcttcgtgttgtcggttttgattaccttagatagttctctcacctttcttttgttttttgcgcagtgagggctcgcactcctgatgcagttgatgacattgggtcatggataaggacgttgaccccgttggccgaggactgccgtacttggcctgcctttcgtaggctgtacggtccgacaggtatcggtttttgccgtgtttcctctttttgttttcactagtggttctttctttggagtttttctttttccttctcttttctgaggatctttgctcgctgtgttaggtcgaagtgcttctataggagcacagaagaagaagaagaagagaaagaatggggctggtacctctaaggtcgtgcccgagtctgatggagaggacacattcattacgagtgtacctggggaagatgcttctgaggccgtcccagttcgggtttctgaggaagatatgctaaaggtaactcctagggtggcgtctgaggccatccctggaggggtttctaaagaggcccaaagggcggaaccccgggttgtccctgaaacggaccccttatcggggccttctgtggagacggcgtcccccgtgccggttgcacgctctgaagagggaggtgccggagaggaagggtcgttggaggagaggcggcgcctaatccgagctgggaaggctgtggccgttcataaggagaaagttaaagcgccgtctcgcggccatgggccggtcttcatggctgatgccatccgttctgggaggcccgccccctggcagagggctactgaggcctcgaccccggcacgtgctcaggagagaggcccgcaggtggtcgtggagggaagaaacgtagatacgggcataactggccccattgctactattagaggcacgggcgggggcggtgaatcctctcgtcaaatggatatgatagctgggccgtctgcccgtcgtatagttattccaaataactataatttgttggagaacagcgaggaggccgcctcgcatatgtcccttttatgtgtcggtgctgagcgcgaggcgttgacagggacgggtaccaagacattgtcccggaagatagcgggggccgctctgcaggtttgctttttggttttgatttctttttcatctctcgacgggtacgacttccctcatgctcatttctgaatccttttgctcatttccctcaggttctcattatggaggcggagcggggccggtgcattcaaaagatggtggagaagcataaaaagctggtggaaagatatgacgaggtgcgtgaagcacaccgatccctggctgacctttataagcaggaccccagctttgaagtgctttgtgagggccttgagggatctgaggcacgactgcagaagcgagtggcggagttggagaaggccgaggagcagctggtagccgccgttgctcggattgccgagatggagcttcttattcagtcaaaggataaggagttacagcttggacgtgtggcggtggatgaggcggcgatgttgcgagctcgagttgcggctttgacggcagaactcgaggctaaggatgcggagattgaggctatgcgtcgtgcgcctgctcagcatgatgcatttcaagatgcccatgaaatgtgggtttatgcaaatgctcgccttgtcgtgtttgaggagctcttgagggagggacgagctactgaaatggaagttgagaggcagcatcatttggagagggtcgcccgtgaggcggcaggttattgttctgattcaccggctcgcgagggcgtcaactcggcggatgttaaccgcttggggtcgagctcttggatttctaaggagtatcgtgagggcgggccccgtgatgatcaagtggagcggagagagcctggtggtggcggattatagttttcttagcacatggctttgtacatatttattttgtatcatgggcgccgacctcccatttttctaggtcggttgtattcatgtttcctttgtttccttggggatgaatacatataacttttgctatagttgatttttaactttgccgtagttggttttctgattttgtcgtagttggttttcgatggccttcggtgatggcttcaactatgccacgtttgttttggcggctttagccgttcttttaagaacaatggccttggctgttcttagaaacaatggccttagccatgtaacgtttccgtttcggcggccttggccgttcttagaaacaatggccttagccatgtaacgtttccgtttcggcggccttggccgttctttagaaataatggccttagccatgtaacgtttccgtttcggcggccttggccgttctttagaaacaatggccttagccatgtaacgtttccgtttcggcggccttggccgttcttagaaacaatggccttagccatgtaacgttttcgtttcggtggccttggccgtttttagaaataatggccttagccatgtaacgtttccgtttcggcggccttggccgttttttagaaacaatggccttagccgtattctcaaatctatggtaatggccgtagtctttctattcatggagatgaatacattggagatggccgtagcctttctatacatggagatgaatacattggagatggccgtagcctttctatacatggagatgaatacattggagatggccgtagcctttctatacatggagatgaatacattggagatggctgtagcctttctatacatggagatgaatacattagagatggccgtagcctttctatacatggagatgaatacattggagatggccgtagcctttctatacatggagatgccgctagtgtagtccctgtatcatgttgggcttgagagtactttggagaggttggcatgatacacttggttcttcaaacatctccaggtgctcccttcgtcgtctcattaaaaacctttccaagaaaacccaattgggacaaaactcggataagggaaaaagagtacgactcgggggacgcttgctcagaagtggaaatgtttgagatgggtgacattccagttgttttggagtgtttttccttccatggtttctagctggaacgctcctttaccgacgactgtcgtgattttgtagggtccttcccaatttgtgcccagctttcctttggttgggtctttagaggccaaagttttggctttgaggatatagtttcccaccttgagtggtcttgcttttactcttttgttgtaatacctttcgatttgctgtttctgcgccaccatccttatgtgggccatttctcttctttcttctgcctcatcaaggtcttggagtctgttggcgtcgttttctgccccactggtgtgtgaataccttaggctaggttcgcccacttcaacgggtatgaccgcttcagttccgtagaccagcgagtacggggtttcccccgtgctagatttgggcgttgtcctgtgcgcccataacacttcgggcaggagttcgggccataaccctttggcgtcttcaagcttcttctttagtatgttcagaattgttttgttggaggattctgcttgtccgttggcgtcagggtggtatggcgtggagagtatccttttgatatgccatttctcaaagaattcggtcgttttctgaccgataaactgtcgcccattgtcgcagctgatttctttggggatgccaaagcggcatatgatgtttttccatatgaaagcgataacttcctactcgcgtatttgcgcgaatgctcctgcttcaacccatttggagaaatagtcagttagaacgagtaagaatcgtacctttcctctacctgctggtagggggccgactatgtccattccccatttgatgaagggccaaggagacgtgactgagtggagaggttctcctggttggtgtatcatcggggcgtacttctggcactgctcgcatctgcggacgtattcagccgcctcttttttcatggtgggccagtaatagccggcccgtacgatgcaacgtactagggcgcggttgcctgtgtgtgcaccgcaatggccttcgtgtacttcttcgagcaccggccttgtttgatgtggccccaggcacttggctaagggtccttcgaacgtcctcttgtagaggtcgttatcgatcatacaatatcgggcggcctgtacgcgaagcttttttgcttcctttttgtctggtggtagtgtgccttcctgcagataagaaatgaactggttgcgccagtcccaagttaggcttagagtaagtacctcggtatggtcgattgccgaatggaggagcgtgaccacgctttctttgccgatattctgagtggccgctgccagctttgcgaggccgtccgcttcgatgttccttgctctcggaatctgttcgaagcggcattcgtcgaacgtatccattaacttgtggatttctgtttggtacttctgcagtctttgttctctgatctggtaagtcacaatcacttggtttaccatgagttgggagtcgcaatggaggactattcggcgagccccgtatttggcggctagtttcatgcctttattttctcgtacgaggacggcgctgactgctacgtcggatacggccaggtatactaagagcggttcgcctggattggctttgacaagcaaaggcggtgatgataggtacaacttcaagttccttagtgcctcggtgcattcctcgttccatgatcctttttcaacacgccgaagaacttatgacatctgtcagaagagcgtgagatgaacctggagagggcggctactcggcctgtgagcttttgcacctgttttttgctgttcaatttttctgggatggctttgattacctcaatctggtctgggttaacttcgatgcccctttgcgacaccaggaatcccagaaattttcccgatgcgacgccgaaggcgcacttctcagggtttagtttcatcccataccttctcaatatttcgaaggcttccttcaagtggtcgagatggtcctctttatttactaattttaccagcatgtcgtcgatgtagacttccatggtctttcctagttattccttaaacattgtcgttaccagcctttggtacgtggcccctacatttttgagtccaaaaggcattactttatagcagtacgtaccttggtgtatgatgaaggttgttttttcttgattctcctccgccatcatgatttggttgtatctggagtatgcgtcgaggaagcttagcagctcgtgcccggctgtagcgtctatcagctggtcgatgtggggcagtgggaacgagtccttggggcatgctttgtttagatcaatgaagtccacatacatccgccacttcccgttcttctttttgaccatgacgacgttagcaatccattgtgggtatttggactccctgacgaagccgtttgctaatagtttgtccacttcttcgcttatggcttcgttgatggtggcgttaaatttcctcctcgcctgccgtacgggcgggtgtagagggttgacattcagtttgtgggtagcgatttcctgtgggatccccggcatatctgtgtgagaaaaagcaaacaaatcagagtgattagataagaaatcacggtacttacttgggtttgacaggccgtggcctatgtaggccttctttgctgggtcgctactgtttaactggacgggatcgagatcctcgaccgtggccctgttggcctcaatgatgtcaggttcgctgatgacgtcttctgtcgggtggaccttggtccccgacacggctgattgctatgctttcgcactcgctccctcgagttgcttagtgtgcgtttggtcttgggctattttgtagcagtcttgggcggtacgcggctcgcccctgatgctagagatcccccacgacgtgggaaatttgattacttggtagaagctggaggggaccgctctcatggcgtgtatccacgaccttccgataatagcgttgcatgctgtctcctgatccatcacgtggaaagtggtttccatcgtgactcccccggccaggacgggtagtcttatttctccggaggttctctccactgcattattgaagccagtgagtgttatacaacgtggtactattttatccttgagtcccattaaaacgaggactcttggatgaatgatgcgtgcaccactgccgtcatctaccatgatccttttgacgtcagtatcagctatgcgtaaagtaataaccaaagcatcatagtgaggaaaagacaaaccgtcggtatcagattatcgaaggtgatactatcttcgaaatcgtcataccgttcgtgagcaatagttcactttaatttgtgtgtggtagtgaattttacatggttgatggctgagtcatcaccgtccccaatgatcatgttgatggtgttgatggtacgggttggtgagggcggccttggcggcccctgtggttgttctcatcctcgtgcgaaattgagttttcctttgtcgctgagtaattctttcaagaatccctggttgagcatcctgaccacttcttgtcgaaggcctatgcagtcctcagtcctgtgtccgcgttcttgatggaattcgcataggtcttttgactttctagtggcggggtcggatttcatcctcgtcggccattgcactttgctgccgagcttctctagtgcgtacactatttctgaaggagatacacaaaagttatgtgcagataataaaggaggcatacctcgctcgttccgtagtggagcgacatgtcgttgcacgacgtcagcattccttggcgggggcggctgtgaagacctgttgtatggctggtgcctttccctgtttgggcgcggggcttgttcccgacgtccctcgctgcgtcgttctctccggattttcgggtgtaccgttgtcaatcgcctggttgggccgttgaggtcgtcgtcgtccccacgaacttcggcacagtaggcgttgtgtatttcttcccaagtggtgggaggatatttcatgaggtggctgagcagtttctttgttgcccttgagccgtccctgctgagcccattttgaaaagctgctactgccataccttctgatacgttgggtaagctcattcttaccctgttgaacctggctaagaactccctgagtccttctcccgaagtttgtcgaatggcgaagatatcattgactcgagcctccgcctttttggccccagcgtgagtggtgacgaacttatccgccatttcttcgaacgtggagatacccctggccggcagctgggaataccaggtcagggctcccccggtcagggtttctccgaacattttaaggagtacggacggtacctattcctttgatagatcgttccctttgacggctgtgacatagtgaactagatggtcctcgggatccgaggttccatcgtataccttcaagtatggaggcattttgaaagtctttgggatgggatacggtgcagcctcttcggtgtagggctgttccacgaattttcccatgtctcttttgggtagcaattttggggcacctgggatcttgtctacccgctcctgatgatctttcatctggtcgcggagggacctattctcgttttccatctcctttacctttttgaggatggccgtgagggtatcgtcaccagcttgcatgtcggtgatcgcatggtctgctcgcacgtcctcgagttcctcctcggctgcagagagatctattgtttgtgcatgcttggtgtcgtttgccggtggcctcctaaccaagtcactcagaacgtcggtcagccaccctgtcaagagttccttgacctctggaggtgctttcgtagaggcagaggtggaggctcccttttcttgcggatctatcagatctctaggtgggggtgggggtgttaccccacttagaacggtactcggcgttgcgtttgtggtatcttccccagctacctcgttgagggatcccaacaggttgactccgggtgttagtgctgctttaaacctcatatcgttgtcagccatggtatgttttacgggaaatttcttttgctggattctccagaaacaaactatagttttgattcacgaaatccccacagacggcgccaaattgtttggctaaaagtttaaggaatgttttaagctaaaaaacaatcaatgtttgtaaatgatgggtaaatcggaaccaaatataataagctttaagagataataatgatagtatattcgataacttgagcaagatagagatagagaaaatagagagagagagttgtatattctttgttaaaagatacacatgaatcttccaaagagggtgaggtctcctttatatactaggagcctctcatcgaaatactgaaagtgaagtacaatggttggtggcctcagggtacggatgtgtcagagcctgcaacgtcgccgtcacaggtcttgtcaccgagttgctttatcccaacgacattcttgcttgggccgtccatactcaggcaggcttagtcaaggtcgtccccaccaatgccgttcttatcagggacgttcccatcaaggccgctccttcatggacgaggacacctacacggctttgaggttgtgggtaaccgaatttgcccaatacaatatcttcttaattgttacacttgctgaaattaataaattagatattgattgaaaatatcataacttgggagtgtggtacgtgcaattctatcttttatatatggatcatgtacggtgcaaatccactaatatgtagtatatttatcgaatttctgttaactactatagttaaacctctctataataattttgtttgttttgatattttttaaatgttataacaaagtattgttatagagaatatatattataatattaacataaaattcgatccaatagaagaagaaagatagcatcccaactagccagcgatgaggagagaagaatctcaatattgtgaattgtgattcatttgatttcctttaatcatcctcaagcatattgcatttcttctatttactagtgtttcttgttcgtgcacccttaaggggactttcatatggattggaatacgaaaataattatttaccatactaaaatctagtgaatggagttctgtatacataaaaagccggagcggctaaaatggataaatctcttttacctaggggtctaactgaatactttgaaaacctctcatctttctatcttgaacaacagaatcaactgttataataaaatattattataaaaaaattattattattataggaaagtctggtcgtataataaatattattagtatttgtataatgtaatatcttttattataatttctaaaactcaaaagagatcctaccaatatttaggactgaaaatgacatgagatgagaggaagaatggctagcgcctgtcgcctaagaattaaaagagctgtgaagtcagaggtcttggaattcgttatttgcaaattcaatacatctctttttttcctctgtcattttcactcactttctttgtattttatcgaggattgaataattcgttgatgtttaatctgttactatttgatcttggtaaaaataaatacgtgatcgatcggatatcacatatgcgatcatatattatatatggacgatttttaaataatatatagacaatttatgattttattaggaattttcaccttataaaaaacgattatggtaataactaataaacgatcaaccggaaatcacttagttgattacaaataatacatgaccgatttctagataacacataggcgatctatgattttattagaatctcccacattataaaaaaaataattttgatattaactattaagcgatcaatcggagataacttaggtagtcataaacaatatacgagtgatttctacacaacatatatgcaatttatgatttcacccactttataaaaaaacgtcttggtaataattaataagcgaacaatcggagatagcttaggcaataaaaaatatacgagtgatttttggataacacataggcgatcaatggttttattatgtttcccactttataaaaaacaatgcaaataacatatgagcaataaaccgaagaccatataggaagcacaaataatacatgagtgatttctatataatatataagtgatctatgatttcaccaggatttactattttataacaaacgatcatgtcaataactaacatgcgaacaactaaagataacttaggtgatcataaataataaatgggcgatttcaagagaacacataggcgatcaatgatttcactaggatcccccactttataaccaaacgacactagttagaactaacaagcaatcaatcgaagatcccttaggcggtcataaataatacatgagcggtttctaaataacacatatgtgatctataattttaaaaggatcccccactttattaaaaaatactgaaaataactgttaagcggccaatcggggatcacttaggtgatcattataacacatgatcgatttctggataacagtaggcgatccacaatttcactagaattatttattttataaaaaaatgattttggtattaactaacaagcgatcaactagagattcttcatgaattatggtgacgagctccaaatcgccgaaaattttgtgagcccatcataaacgacctaatgagcaatagtcatcgctttgccatgaacattttccattttgttagtattttagggccaaaaaaagaaattctagatgatctttaatttttcgtgtgataatgtctacaccatctatatgaattcaaccgatgagttcaaaatcgcctaaatgtttgggccgtcgaaaataatctaaggaacaatagtcatcgctttgccatgaccgtttctcgtttttgtattatagtgccataaaaatggaattcccctcgaatccataattttcgtgttaattgctagtcgacctgatataatattttgtgtgtgtagatgttccaggttacaaccagctcccaaagagtctcaattaactgcagtgaaatgaactattagatatcttattgggactgcatcacatgatttatgatatccacgtcttaactattttaagcttgaaggtttctcagatgcaggtcttttgggagataaagaagataggaaaagcacaaatggaacatgttaattactaggaaaatcactcatctcctggaatagtaagcaacaaggatcagtcatatttatgttcaaattttttttgacccctacgggttccgggccgggcaggttccgggttgaaccttaacgggtttaacgggtacggattaattcgggtaaaaattaaaccataagggttacgggttgagggggccgggccgggtttagtgtatatttaattttttttcttcgaattttatataactattgtaagttatattaatactttgtattaatttaaagaatacatggaagttggaaaaatatagcacttataaattgcatgtactacatttatttcaaaattcaaaattaaagtttgcattttaaaagataaattaacaaaaagtatataaagcattcattaattgaaattttgtataactaattaactattataagttatattaatacaaagtatgttataaaaaataaaaaattaagaatataaggaagatgggaaaaaattgcacttattgcaagtgctacttttatttcataattcaaatttcaaagttacaaattgaaaggtttatatttttaacaacaagtaaaatagtaaattcgaactttcaaaggttttgcattgccttaaaaagttcttcataatcaatatgaaccgattgaccttcttctggagtgttaaattcggatgggttaccatgtgttaatatatctccaagttcctcgtcttctgggctatcaacatcttcacgtccttgatttcttcgttccgatctaatccaatctctgaaacatactaaaacttccaaagcattgcttcccaatgagtggcgggtatgtccaagttgttgtcttgcttggctaaatacactctccgatgcaacagtagaaattggcacattcaacacgtcccgagccatagcagaaagaacagaaaattgattttcattctcatgccaccatcccaacggtgaaaattcctttgtgcgaggctctttttgcttctgcaagtagaattgaagttcatcaatgttcctgctactggtttgagtgttagaaaatgtaaaaaaaatattataactatcaaggccttcttcatcattcacagtagcagaagtgctactttgcatgggattaacactggctacagcaggagcagcatcatcagcagcagttgcataataatcatataattgtcgtaaataattatttagcatgttcatagaagtatataaatttgaggtttcagtttctccaatctccatataagtatataaagcattcattaattggtgacaatcagacatcttaatagaaggatttaaaactgcaccaattaagtaaatcggaggaattggaaagaaatattttttaattttttcttgcattttttcaataacatccttataattttctttcttcttaaatttagagagtagaaaagaaatttcagctatatgtagtaaagccatagtaacagtagggtaatatgctccaaaaaactcaacagtagctgtataaaatttatgtaaaaatttaacaacgtcattaacgacctcccaagtatcagttattaacagacgggttggattggtataatgcgcattagcaacttcagttattggaaatatgtatttatagcaatattttaaaaatatatatgtataattccatctagtaataatttcgtcaggcatgaatctgggtttaaggttattctcgacacacttattcttaaattcttttattttagattatctattatttccttgaataacaccaactgctcttctaacaaggccaatcgcaggtgaaaataaatcaaggttacttttaacaattaaattataaacatgacatgcactcctaacatgaaaaatttcagcaagaggtgtttcaaatgcattcttaatattggaattgcggcagtgttgttagatgcattatcaaaagtcatacacaaaactttttccttcagattataaaattcaacaacttcacaaacagtactacttataaaggacagtattatgattctgatcttcatcatatctaaaagcgataatacgtttttgcatacaagtactatcatctatccaatgacatgtaattgtcaaataatcatttccattaacagcatgaccaatatcagaagttagggaaactctaccaggaaggtggctaaacaaataacgtaagtatgtttgatattatctatgaagtctaaagatatcagctctacaagtacttctagggatacctttaaataaatgattgtaaatcctttgaatatacataataagatatgatgaagaagcaaaagaaaaaggtagacaacccaaagcaatcattttagctaactcctcacgatccctcatttatcatatttcagtagacctccagtagtagggttaatagttatttgatttccatcaacatcagtgccccattctatgggacggtcaattctcatatgtctactaagcgtcccagtttcccctaaatttcctccagtcaaatgtttaaaagtatcgttacaaattttgcatctaactttatcagtaccttctattatttcaaaaaaattctaaaccttacttctttttctacgattagaagtcggagccacatgtggtctaccagtagtggtgccacgaccaccaccccttgtagcactagcaactccaactctaatactaccaactccagcactagtaggtgcagctggtatctcatattctattcctatttcattatcttctattccaaaatcttcttgtaattgttcataatctatatctacattatcattaggcgatgattcagaaacatgtgtaaatgataatgggttattactattactaccagaagctgaaggactacctcttttgttattttcacccctatcagtaactcttttacacgctcttttagcagcattaaacatattgtaaaaattaaagtataagctaaaattaaatatgcaattaaaatattaaataagagaaagagttggaaggagtgcaccgaattcgacaataaattgagcacttgattatgcaattccgatgttaccacgaacaaacgtcaagcaagtatttaaatttttaacttcaaacttcaaattccgaatgacaaattccgataaattaaattcaagaaaagagagtcatttatgtaaagtgttaaaaacataaaattaaaaggttaattttaataaaggttatttatagattttaaaaaggttaattttgtaaagtgttaaaaacataaaattaaaaaaaaatggccatttatgtaatgaatcctttggccaacggatacattcagcaaaaggctgaaaagctggccctctcctacggataggcagtgggccctgtagcaaaattcaaaaaaacaaaaaaacaaaaaatttagccgttaaccgggctggttccggtccgggttaactggtttgggcactgttcacgcctaccggtttaccctggtccggttaaccgtatcccagaactgaaccgcacaaattcggcctaaccccctacccagcccacccggccccctttgaaccgggccggtccggtcccgatttgtaccagtctgggccggtccggtttcggtctgacccgacccgtttgacaggcttagtgacattatccataactgaggctgaatacattgttatcagacaatgatgtgctcaactactctggaagattcaccaactaagtgactatgatctttcgtttaagcctgttaaattttctgtgaaaattctagtgctattttcttgtcaaaaaatcaagtacatcattatagggcaaagcatatagatatcaagcatcattttattagggattatgttcttaagggtaacattgaattatcttttgttagtaccgataatcaattagttgatatttttactaagccttttttagaagacatatttcaaaaccatatggatttacttggcattattactttttctgaataggccttcgaaatttctgcacttttcaaagattatgtgtgatagtaattttggtaggaaatctttttgtactttcatatctaatcattaccgccagtagcattaatgagacaccttcctttttaatccctcttcctacctttttcgtactcccagatggaaactgaatcaattgatcgtgtatgttccctttctctacacccatcaatcacgtcgtttctatcacgccttcttacatctatatatataaatgacttccttctccttagccctcacattgtaaccttcaccctctctttccaatggataaagcttcaaaaaacccttctgtctccattaacaaaagcacccgttccaaaggaaaaatccctactcaaccatcagaacccttcaccattgggtctgatcactctgaggacttttcatcttctagggcagacctctctgatgatgctcgaaactttactgaaaaatccctaggaaagcgtcttatagaagaaggagttgaagcctacaccacaaagaaagtgaagataaacttagacagtgtgataagtcggaaatgaactatagggattcacccaacaaagacaagtttgttacctttaagagaaaatcaatgctcatgaaagaatcgtcaatttggaaaggatggatgccctaaattacaaggtaaaagattttttttagttttcagggatagaaaatatttctttggtctaacccatctaaaggtctatgaagatcttgttcacataatctattgaaatcttcgatcccccaattctgataaaatagagtccctcgtgctaggttagcgtattgttctagacggtttcacctttgattcttcatttcaatgtaaaagttctatttactctagtcagtttaaatactcttggcctgaagattgtgaagtgtcatttgaacaagctaaaatacgtctagttgatttcctatctaatcccttgaccaatcaattaggacctagtgacatcaattttgaagcccgtgttcttgctcatattgttgccaccaccataatttccagaacatgatcctataccactctatcttaacgagacacaattctggtctactaccttcttacaaagataaagttgtcacgacccgaattttccacccccgggagtcgtgatggcacctactaatgtgagttaggcaagccaaaccttaacaaattgctaacctttttcatattacttctttataaccaacatggaacaacaatataataaaaatgaaattttatagaatttaagtggaagtcttcaaatatttaatcaagccatatctattacaactttaaaactcaacacccccaaaatctggtgtcacagtatcacggaccgtctaagagtcactaaatacaaagtctgaaaaagtacataaaactatttttgaacaagaataaggaaacatgaatggaatagagggggacaccagggtctgcggacgcctgcaggtctaccttgggtctccgagtggactgaaggaagccctccaactaatgtccgatagctgctctgggatctacacacagtgcagagtgtagtatcatcacaaccgaccctatgtgctagtaagtgtctagcctaacctcggcaaagtagtgatgaggctaagaccagaccagcaaataacctgtgcagtttaaatatatacggcgaagcaggaaatacagaaacagtctaacaatgtgggaaatggaacatgctgtggggagataacagtttcaaataaagacaactagtaaggaaaaaaataacataactcgaatataaataagaaatcaataaatcaatagttgaacgacaccacccttcgtgcttttactctcatcctcaccaaaacaatacacggcatcacccttcgtgcttttacctcacataatcatggcacagaatgatccttcatgcgttaacactcatatcatggcacggaatggtacatcgtgcggcacagcatcacccttcatgctttacatattctcatcataatcatacacggcatcacccttcgtgctttacgctctttcctcacaaacaataatgcacggaatcacccgtcgtgctttatcacttttcctcacccaaacaacaataacaaacaatggaacaacaatcaaacaactaaatcctggcaagggagcaataatcaataatatcatcttcccggcaagggaacaatttatacctctttctctttctttcactttcatttcataactcattctaacacttgaaccaatgctccaaagtgtgcaattatcttataaactctcacaatttgtattgtaacttgagccaacgctccaagggttcaatcaacccacttgctttcacaatttcatagtataacttgagccattgctccccgatgttcaagaaccacaattacttcattaacttttcacaacaagtagaaatcaaatttaaagcatggattattcaacacattcatcaagttcacgttataagactcacagtcatgctagatgtaagcacgtgatttttgacctatcaaaattactccaaaagatgaataattccattactttgaaagacttttgcggaattttgaagaaaatgctctcggcgcacgataagccaagggaggctaacgtgcaccaacgatggtgaggagacgcaaaccaataacgccggcgactgaggtcaaaactccggtgagctcaacaatgcaaactttcactccactaacgtttggaagttttttaccaccaaaattccaaccgatcttagaagaaaaagagctaagtgaggaagaagaagaaatcagagtccaatgtaacagtaacactgcgatgaatgctaaggaaacccagaaagctaaggaacaactaccaactagtcctaagcgacttcaattctctgaagcaagatcttcgcagccatccccaggtccagacctagtggcaaagactaacatggcaaaggagctgaggaagcaaaatcgaaattcccagatgtgaatgaagttggagtacattcagccaagccatagagaaggtaagattgtcatccaaattgaggaaaatgatgtgaatgaattacaggaatattgggcaatagctttaattggatatgtacttggtgacactccatatgagaaatctatggaaagttatgttgaatcagtttgggattttgttaccaaacctcagatcttgtatcaccaagatggatattatgtgtatagattcatgacaatggaagatagagatacagtaatgcaagctggaccatactcttatcacaacaaaccgtttatcctgcagaactgggagagatattttcatttcgatcccaaatgcattactactattcccctgtggattcatgtacctagtctatcagttggttattggactgctgatgcactaagtaaggtggcaagtgcagttggaattccattgtatacggataagttcacagctgagttgaacaaaatatcctatactcgaatgttggtgaaagttgatattacaaagcctttagtggaggagattgagataatcacccccactggtactagacaacaggagatagtttatgaatggagaccaaagttttgtaatgactgcctacactttggccatgacagcttggaatgctggaattcaaccaaacagaaggaagaggcagagttcaaggctccaaaaagaaggaatagaggcaggggaaggaaagtcatccaagagtggaagcctaaaacacaacaggaacaagaggatgggaaaggagaggaggacaaaaatattctcccagctactattgaaaaaagaaaaccagatgatggtaaacaaaaaggcaagatgatacaaagtaaggacacagctgaaatgcagacaatagcagatcatcaggtgagtaataaggatgcaactacctccaacagattctcaatcttggaggaatgcaatgtccatggaggggtgagcagctctgatcatatgcataaaccaccatgaaagtcagcacatggaacataagggggccgaacaagccccataagcagaaggaactgagaatctttctgcaaaagaataagattgacatccttggatgtcttgaaactagagtaaaagaaaaaaaggcaaaaaatattctgtataaagtagcaaaggattgggggcactgttataactatgatgaagctgaaaatggaagaatatggcttatttggaaaacaaatctaacagtaaacataatccaagtccatgaacagttcattcactgcatagtgatggacactgtgactggatacaagattgtgcttactgtagtgtatgccaggaacaagcagcatgagagggagaaactatggtatgatctgcaacaattagggggacaagttcaactgccttggctaataagtggtgacttcaacaatgttttaaccactgatgacaggttaggacaaccagtcactatgaatgaattacaggaatttaaggaatatatggacaatatgcaaatgactacactaagaacaaaaggctgtttctttacttggtgtaacaaacagagtgcagatgatagagtatacagtaagatagactgggctttgggaattttgaatggaccaacatgtatgggcatgtggaagctgattgtctggagcctggagtatctgatcactcaccactagtgatccaaatatgggagagaaggagtctgcatcccaagcctttcaaactgtacatggtaactatggagcataaggactttaagcctactgtagaaagagtctggaaacaaaagatgggaaatgatcctatggctggtatatggatgaaaatgcaaaaattgaaaggataggtgagatgcttgaataaggagatggccagctacactcagagactgaacaaaattagataggagctagaatgcacacaagcaaacctgatacttgaacctctcaatcaagtgtggatagaacaggagaaacaagcactccaggatctagaaaagtggagcaccatagaggaaagaattctaaggcaaaaggctagggtaaattggattgactatagggattcaaattccaaatacttctatgcacaattgaagatcagagcaagcaagaatatcatcacatcagtgtacaatgaagtgggaatcaaaatcactgagcctaaagctgtagaggaggaattcatatgctttttcaagcaacttatggggaaggatactggtttaaagccatgcccaaatacagcagttatcagagaaggaagatgcctcacattacagcaacaacaggatctaattcaagaaatcacatgtacagaaatagatgaagctgttcaagacatgccaaatgataaagctccaggtgttgatggttttccaattgagttctttacaaagcactggcaggagatcagacaagacatatatgatgtagtgaagttcttttttcaaacggggaagatgataaaatcatggaattgtactgctgtaaccttgattccaaaggttccatcccctacaacagtgaaagattataggcctatagcttgcactactgtgtacaagattgtggcaaagatccttacaaagagaattaaaaaggtgattgaagcaatcacagggaaagcacagtctgcttttattgaagggagaagcataattgataatatcctatttagccatgaattattcaatggctataatagaaaaggcttatctcctagatgtgtgctgatgataggctataattacgcattttagtcgcttattacactcgagtttactgcactttaattgagtttgagctttaatcgctagtgttttgcgctaattgtgtgttttatgccttgtaggtgtgattccgagctatatagatgttatggaatgaatttaagtgatttgaagctttgaagtctgagtaaaagctcaaggaattaagccgggatcgtgttcgggggtcaaatttgatagttgagtacaaacgaagactcgatgaggcatattgcgcattgtctagtaaaatgcacataacttttcgctcagaactccgtttgggctccataatatatcgttggaaagctattcgaaagagatacaactttcatcttttgagtttcagctaattatcactatcgcgctgcatgggtgcgccgcatgggcgcggcgcgacaggccaaattttacagagctgtcctatttcgcgcaggaaagggttttttcgtctgggcccgaccctacttggtataaatacatgtaaaaacgctattttgagggatgagtacatatatttgacatagatttgacctaaggagtcaagaacacaatagaagcaaggcgggaaattcttcaacgagttttttccttcctcttcttatctttcattgttggttatgacttttagtattgtagttttacatactattatgaatagctaatttgttatctagagttttgatagaaccttttgtaggataaattcttgttatgtttttatataattgagccatagttttctctatttgttcaactacgtttatattgtggttggttgaagagctctcaattaactgtgcctatttagtatgcataactcgggagagagtgcatatttaggttattgttgaacaacaccactcccaaagtataagagggatctataactgcaggtttaaaggcgggattatggataacgaagccttgggtgcgatctgaagtgagctgtattaaaagccagctagcgtagctagggagagtgcgactagtaaattatcgtgattactcggaagagatttacggtaataagagtgctcatgatcggtagagaatacttaggcaaaattatagaagacatagcgggaatgattccgacaattggggaaatcataactctagtcctccttaatcttatctctaactcttagtatctgtagttgttaatttattattttaatttattagttaattagttaaacacaaaaatctaaatatctataagttaggaattgttcaagcttgtcttcttggtaatattgaacagttgtggctaagctttagttctctgtgggattcgactccggacttgtaaactggattatatttgcaacgaccgcattgtccttttataaggcatagttgggcgtgaccaaattttggcgccattgccggggaacttacggtgtagctgtaggtgtacatattgctaggtttcaagtttgaacttttatttttatttttattttttgtatttgatttttttttcttttcttttttcgttttagttgttgattttaaaaataaaaaaataaaaaataataatatatggcatcatggaattatgaaagttttgatgttggtaattctacttttaatcctccctatgcatattgtgatgaaaaccacccttggcaaaattatcaaaatattcccgagagcgagttttgtgcaccaactcaatcttatgtgtggaatgtgtgtgatatgtgtggtggtcaagatggtcactttcatggttgtgcttatatttcttatcttcccccaaccccttattatgatgattctatgtttccttgtgaggataataggaacaaagaacctcgggaagctgacctaaagaagatcgaagatatgttaacatgccttatagaacaacaaagtaaaatacttctgcagatagaaagacaagatgaaactattcacaacttagaggctcaagtgagtcaattagttgaagattttaatgctcaatatgtcaatattatggatagtagccaggagcagtttgcattagagacgaaaattgaggtgccaaaggaggggtccagagtagaacaccaacaatcaatcgaactagattttgaggatgccgatgtcgtagaggaaatactagagtcaaccacggatattgaggatacatatttagttgactctattgtcattagtgttgagaatgtagactgtcctaatgttcatgtagttgagcgcattggtcctcactccaagcattttttcacattgtgtttagatgatgatatggaaatagagtcatccgagccacttgaggagtcaaggaatgaggaacaaagtgcttacattctggaattcttcttgccagaaagtcgggattacacacctcatctaaaggccaagaagtgcaaaatactgcattattttattgggccagtcagattcgttctaccaccccaagaacatgatcatagagcagaatcaaaacttggggtccgattcataagttcaaagtggaggcaaaaagcgattcacgtcgtgccgcgacgttaaatcaagcgcttgttgggaggcaacccagctgtactgctttcttttattttttgtattaatttttttaattgtattatttttgtagtgtcaattttttattttctaggagcagggaaagcaaaggtattggaaggatgaaacagaaaccaaatggttggaactaagtgtgaagtacccgcacgaaggaccaagcttgggagaagtctgagtaccccgtgagctgttaatgcttcggcctttggcctaccagggagtctcttttaccctttttattagttattgtgtgcattggggacaatgcacaattttaagtgtggggtgaggagattgtctggatgaatttctatgctattttagttgtgttagcttaattgaataatttttttttaaattgaaaagattggacttttcccgacgatggatctattagacaattttcttgagggatttaagtctaaagaaaaagtacaaaaagattttcttttgttaggtagtgtaataattaccccttggtttttctttaaaccacggttcttttccaagggttttatttgaaccgggtgtagttagtttttttttttggaagtaggagccattgtgttgtgttttgaattgaagcaatatctcttgactttgttataccttgagaatagtgagtactttggttgtgacgcttaagctcaattttgactcttgtataagtaccttaaattgtatgttcttaaaagttgcttaactgctttgactagagtgtcgatgaatccaatcctgagtgagttatgtgccatgtgtgtgtgaggtttgttgtattctgtgcattgcatttgatgcctagaacttgccccgtgtgtttgcaaaacgaaatagtagttttattcagtctaggaagtgatatagacatttctttgttgagccagatatacatattttacccacctaattgtgatgtatcgtagttaacccctttgagcctgtaatcttatttctttggcaaccacattacaagccttacccatttgtttgaattaaccatctatttgaaccttttcacctctcgtgagcacttgaattgttatgaactttgcaaaagttaaagtgtggggtggttggtttggcttttgagtggaactaatgaaataaggagaaagggtgcattgatttgaaaagcaagagccacttgaattgaaaaagaaaaaaaatgattagttgtattgttgtaaaaaaaaaatattctttgatggtggtgactcttgatataattgtgcttaaataatttgggagttgatgtatattgatgtgaaggtggagtttggcttgacataagtatggggtttgaatgttaaagtatatgtattaaagtgcttagggaggtgtagtcactcttatatctaaatgtatcctacccgtcccgtagcctacattacaatcaaataaagtcctaattgatcctagattgaatgagctcgattagtggagtagtacactacgggcaagcttatggtgcatcttttgtggcatatgaatgttatttctgagagtgagtgaattctttctatcttgagttcctaattgttcttaaattctattgtgtggaactactctcttttggttgtgtgagggcacttgattcatgaaggaaaggtaatgtcagtgacctctatgttagagtaagtaggtgagttgtgaataatgcgtggtacttgtgagtcaaatcttgaggtgaagatgttatgcttttgtgcttagtctattttaaatactcttggtgtgatgagtcaggagaattgtttaaaaaggtcgtgtctataaaaagtgtagtttgattgctcgaggacgagcaatggtttaagtgtggggtgttgatgataggctataattacgtattttagtcgcttattacactcgagtttactgcactttaattgagcttgagctttaatcactagtgttttgcgctaattgtgtgttttatgcattgtaggtgtgattccgagattataatagttaatgtggagctaaattgatcaatttgaagctttgaagtctgagtagaagctcaatacgtgaagtcgggatcatgttcggggtcgtgtgctaagtctggatgtgaaaagaaggcaaaatagctggctcgaagaaaaatgacttaccgcgtcgcggggccacgtcgcacggccgcggcgcggtagtacaaaatgaggccgggggagaaaaagcaaagctgcagacaaaggccactgccgcgtcgcatggccgcgtcgcatggccgcggcgcggcaggccaaattcctctgagcagtcccacttcgtacaggaaagggttatttcgtccgggcccgaccctactgggtataaatacatgtataaacgatattttgaggggagtacatacgtttgccatattttagacctagagagtacatatttttgacatagatttgacctaaggagtcaagaacacaagaagcaaggcggggaattcttctacaagtttttctccttcctcttcctttctttcattattggttatgacttttagtattgtagttttacatactattatgaatagctaatttgttatctagagttttgatagaaccttttgtaggataaattcttgttatgtttttatataattgagccatagtttttctctgtttgttcaactacgtttatattgtggttggttgaagagctctcaattagctgtgcctatttagtatgcataactcggaagagagtgcatatttaggtaattgttgaacaacatcactcccaaagtataagagggatctataactgcgggtttaaaggcgggattaggaataacgaagccttgggtgcgatctgaagtgagctgtattataagccagctagcgtagctcgggagagtgcatctagtaaattgtcgtgattactcggaagagatttacggtaataagagtgctcatgatcggtagagaatacttaggcgaaattatagaagacatagcgggaaggattccgacaattggggaaatcataactctagacctccttaatcttgtctctaactcttagtatcgttagttgttaatttattattttaatttgttggttaattagttaaatacaaaaatctaaatatctataagttaggaattgttcaagcttgtcttcttggtgatattgaacagctatagctaagccttagttctctgtgggattcgactccggacttgtaaaccggattatatttgcaacgaccgcattgtccttttataaggcatagttgggcgtgatcaaattttggcgccgttgccggggaactaacggtgtagctgtaggtgtacatattactaggtttcaagtttgaacttttatttttatttttttgtatttgattttttttcttttattttttgttttacttgttgatttaaaaaaaaataaaaaaaatatggcatcatggaattatgaaagttttgatgttggtaattctacttttaatcctccttatgcatattgtgatgaaaaccacccttggcaaaattatcaaaatatttccgagagcgagtttggtgcaccaactcaatcttatgtgtggaatgtgtgtgatatgtgtggtggtcaagatggtcactttcatggttgtgcttatatttcttatcttcccccaaccccttattatgatgattctatgttttcttgtgaggataataggaacaaagagcctcgggaagctgacctaaagaagcttgaagatatgttaatgtgcattatagaacaacaaagtaaactactgctgcggatagaaagacaagatgaaactattcacaacttagaggctcaagtgagtcaattagttgaagattttaatgctcaatatgtcaatattatggatagtagccaggagcagtttgcattagagacgaaaattgaggtgccaaaggaggggtccagagtagaacaccaacaatcaatcgaactagattttgaggatgccgatgtcgtagaggaaatactagagtcaaccacggatattgaggatacatatttagttgactctattgtcattagtgttgagaatgtagactgtcccaatgttcatgcagttgagcgcattggtcctcactccaagcatttttccacattgtgtttagatgatgatatgaaaatagagtcgtccgagccacttgaggagtcaaggaatgaggaacaaagtgcttacattctgaaattcttcttgccagaaagtcgggattacacacctcatctaaaggccaagaagtgcagaatactgtattattttattgggccagtcagatttgttccaccaccccaggagcatgatcatagagcagaatcaaaacttggggtccgattcataagttcaaagtggagggagaaagtgattcacgtcgtgccgcgacgttaaatcaagcgcttgttgggaggcaacccagctttattgctttcttttatttatttattttatttttttaattgtattatttttgtagtgtcaattttttttctaggagcatggaaagcaaaggtattggaaggaccaagcttgggagaagtctgagtaccccatgagctgttagtgcttcggcctttggcctaccagggagtctcttttacccttttattagttatggtgtgcattggggacaatgcacaattttaagtgtggggtggggagattgtctggttgactttctatgctattttagttgtgttagtttaattgaataaaaaaaattttaaatagaaaagattggactttttccgacgatggatctattagacaattttcttgagggatttaagtctaaagaaaaagtacaaaaagattttcttttgttaggtagtgtaataattaccccttggtttttctttaaaccacggttcttttccaagggttttatttgaaccgggtgtagttagttttttttttggaagtaggagccattgtgttgtgttttgaattgaagcaatatctcttgactttgttatgccttgagaatagtaagtactttggttgtgacgcttaagctcagtttttgactcttgtataagtaccttaaattgtatgttcttaaattgctcaagtgctttgactagagtgtcttgatgatccaatcttgagtgagtcatgtgccatgcgtgtgtgaggtttgttgtattctgtgcattgcatttgatgcctagaacttgccccgtgtgtttgcaaaacgaaatagtagttttattcagtctaggaagtgatataggcatttctttgttgagccagatatacatattttacccacctaattgtgatgtatcgtagttaacccctttgagcctgtaatcttatttctttggcaaccacattacaagtcttacccatttgtttgaattaaccatctatttgaaccttttcacctctcgtgagcacttgaattgttatgaactttgcaaaagttaaagtgtggggtggttggtttggcttttgagtggaactaatgaaataaggagaaagggtgcattgatttgaaaagcaagagccacttgaattgaaaaagaaaaaaaatgattagttgtattgttgtaaaaaatatatatatatattctttgatggtggtgactcttgatataattgtgcttaaataatttgggagttgatgtatattgatgtgaaggtggagtttggcttgacataagtatggggtttgaatgttaaagtatatgtattaaagtgcttagggaggtgtagtcactcttatatctaaatgtatcctacccgtcccgtagcctacattacaaccaaataaagtcctaattgatcctagattgaatgagctcgattagtagagtagtacactacgggcaagcttatggtgcatcttttgtggcatatgaattttatttctgagagtgagtgaattctttctatcttgagttcctaagtgttcttaaattttattgtatggaactactctcttttgttgggtgagggcacttgattcatgaaggaaaggtaatgttagtgacctctatgttagagtaagtaggtgagttgtgaataatgcgtggtacttgtgagtcaaatctcgaggtgaagatgttacgcttttgtgcttagtttattttaaatactcttggtgtgatgagttaggagaattgtttaaaaaggtcgtgtctataaaaagtgtagtttgattgctcgaggacgagcaatggtttaagtgtggggtgttgatgataggctataattacgcattttagtcgcttattacactcgagtttactgcactttaattgagtttgagctttaatcgctagtgttttgcgctaattgtgtgttttatgccttgtaggtgtgattccgagctatatagatattatggaatgaatttaagtgatttgaagctttgaagtctgagtaaaagctcaaggaattaagccgggatcgtgttcgggggtcaaatttgatagttgagtacaaacgaagactcgatgaggcatattgcgcattgtctagtaaaatgcacataacttttcgctcagaactccgtttgggctccataatatatcgttggaaagctattcgaaagagctacaactttcatcttttgagtttcagctaattatcactatcgcgctgcatgggtgcgccgcatgggcgcggcgcgacaggccaaattttacagagctgtcctatttcgcgcaggaaagggttttttcgtctgggcccgaccctacttggtataaatacatgtaaaaacgctattttgagggatgagtacatatttttgacatagatttgacctaaggagtcaagaacacaatagaagcaaggcgggaaattcttcaacgagttttttccttcctcttcttatctttcattgttggttatgacttttagtattgtagttttacatactattatgaatagctaatttgttatctagagttttgatagaaccttttgtaggataaattcttgttatgtttttatataattgagccatagttttctctatttgttcaactacgtttatattgtggttggttgaagagctctcaattaactgtgcctatttagtatgcataactcggaagagagtgcatatttaggttattgttgaacaacaccactcccaaagtataagagggatctataactgcaggtttaaaggcgggaatagggataacgaagccttgggtgcgatctgaagtgagctgtattaaaagccagctagcgtagctagggagagtgcgactagtaaattatcatgattactcggaagagatttacggtaataagagtgctcatgatcggtagagaatacttaggcaaaattatagaagacatagcgggaatgattccgacaattgggaaaatcataactctagacctccttaatcttatctctaactcttagtatctgtagttgttaatttattattttaatttattagttaattagttaaacacaaaaatctaaatatctataagttaggaattgttcaagcttgtcttcttggtaatattgaacagttgtggctaagctttagttctctgtgggattcgactccggacttgtaaaccggattatatttgcaacgaccgcattgtccttttataaggcatagttgggcgtgaccatgtgctaaaagtagacctaaggaaagcctatgactctattgactggcaattccttaaattcatgctcacagacctgggctttccacagaaattcataatgtggataatggagtgtgtgacaacagtgtcctactccttggttctaaatggaggattaaccaaacctttcccaactagaagaggcataagacaaggagatccaatgtctccttatctctttgtgattgccatggaatatctacaaagggagatgaaacaattagaggctcagaagcaattcaaattccatccaaagtgcaagaagctgggagcaacccacatatattttgctgacgatttgttaatgttttgcaggggtgatgtaaactcaattacaaaactccaggaagctttcaataaattttcagcagcttctggattgcaagcaagtgcagaaaaaagctcaatttacttcacaggagtggcacagcatataaaggaacaaatactagaactcactggatatactgaagggacattgccttttaagtatctaggagtaccactgtcgacaaggaagttaaacatccatcaatgtctgccactggtggagagaattactgaaagagtaaggtgctggtcagctagattgctctcatattcaggaagacttcaattgatcaagtctgtgctatttggaatacaaacatactgggctcaaattttcctattgccaaagaagatcataaagatgatagaagcaatctgtagaacctttttatggactggctcaactgagtactcaaggaaatctttgatagcatgggataaactatgccagcctaaggctgcaggaggactaaatatcattaacatggggatatggaataaagcagcactgatgaagcactactgggcactggctttgaagaaggatgtactgtggatcaaatgggcacatacttactacataaagaggagagatattgcaaaaatggaaatacccaaaacagcagcttgggtaataggaaaaatcattgaagcaagagaggagataaagaagataagtctgggacaacatattgcaggcacactggagtcgctaacaagacaagggaggttctaaatacacaaagcttatgtgcaactgaaacctatgcatccaaaagtaaggtggaaaagtctccacatgcacacacatgtccatcggctggctattcatcaaaggctagcaacagtggacaggctcatgacctttggaatacaggttccactaaactgtgtgttttgctcagctagtatggaggaatttgaacatttatattttgactgtccaaaaacaaaaaatttatgggaaagattgttgacatggttgggattcacaagacaaataggaacttaacagaatgaggtaatgtggatcagcaagtaggcaagaagtaagaactggaaagcagcgataacaacagcaacatttgcgatggttgtatattgcatttggcgtgaaaggaactcgattagattcaacaaaggcagatacaatatagaggaaatatgtaaggaaattgccatgcacatacacattcatggaaggacaaaagcaaaatggcaacagaacttggaaagcttaaataagtttccatagcatagatagttatagctatagtgttagattatagatgaaatctgattactgacactcggatgtagttcatgtaaatagacataggagattaatggtcagcattaatttggttatgtaatgatagtttttgatgaaataaaaagttagttttatcaaaaaaaataaaaaattactcccaaagaactcaagaataaaataatttttgcgtcgttcgcaattttgtggattttgtgacatttttcttttaattatttgtatttgtttgtgcgtgtttatttttatcttaattaagaaaaaatacaaaagatatatgttgcatgcatttaggatttaattttaaaattaggaattaattaaacaattttggctttacaagaacgaaaatcacaaaagataatttactgcgcatttttggcattagatgtccgattgtgcgattttgttttctaattgatagtcaattatgtgtgataattattattaagagtcaattagtattttaagttaatttttgggttttgatttaatttagaatttttggtaattaggaattaaaaaagaaaacaaaagaaaaggaagaaatgaaaaatagaagagaaaaatcggaccaagcccaataccctaccaggaccaagctctcaaacccggtccagtccatcttcgtgcccagccaaatgacgccgtttaggcgtctcagatctgaaccattgatcaaacagatcgaacggtcctgttcagctcccagcatcgttaaaacgataccgtttcaggtgtgttgatctgaaccgttcgttccctttgatctgacggtcccaaggcttccccacaacctgactcatttatccccgggtcaacccagtcccccatctaagcttaaacgacaccgtttcatttaagccattgatccagccgttgatctcaactgatccaatggccaggatcaaatccctaacctcgtatataagtaaccaaacacaccccatgcccccctcagaacaccctacccctttgtctctgagttcagagacttgaacccctcccctgaaaccctagcctccaccgttccctttgcctgaaaacccaacggcctgaggtccgatgaccctcaaattcacacccctgaaccttctaaccaccttcaacacaaatccctaccctcttaacctcgaatcatcccggtttgtttcgaatcttcaatcgaagattcgagcaaaaccctaaacctaccccaaccaggcccaaacttagaccctgtgaccatttgacctccctcgttcccaaaccaccattagtttccctcgaatcaatccgaagctcttcgatttttaaatcacacgggaaaaccctaggaggaccaaacctggagtcggtccgagggaaaaaggaaattggggttttaatcgactttagtcgagtgttctcagtcgagaacactcgattaaagtccgtttttacctcaaaaggttcaagtcaaaggtcaaactgatcggagttcgtttggtttttattttgaggtatttttcctccccttttctgttctatttttgttattgtttatttttttaggtttgttgtattttgtttgattgatttttcgttatttttttcgattatcttcttctcctcttatggacctttttcttggtccaatttccttctgtcaattgacgtaggttatgaatagttttgacgattgatccattttgtttgtagtccagtagttctcatcaattggtttgatgtcggatgttttgtatgttgatcattagatacttagctttagggctcattgccaatatactgtcggcgatcctacatcttgtataggtttgattccctgctcgttcatttatgtttaagctaattatgattggttccccaatatggttagcttactccctgtatatgtgtaatcaatctgaccttaatagtctaatgtatgtggctttgaatcattggttcttatgttgatactatttggtccaatttgaatacaagcttgaatagattttgatgagttgaatcctgatgttgttttgtattgaatttagttttgatatgcttgttaggagtcagttcatacggctaagtaatcgattgataagttgaattggttatagctgatagttttgggacagattaaagaggtcagggtaggatagtaattttagtagctttaggagggtattttgggatgtcaaaagtttgaaattggtttaatatggatggtctgtcagttaagtactaataaagcattaactaatgtatttgattaatcataatggtttgggaaacataatagcatgggatagttctaagggaaagtgactaaataaatagatgcccataacctttgaactaaaaaaaagaaacaagacatagagtagtggggaacaagggaatcaaaaagaacaagacatatggtagtgggggttcagggagtgtgggcagaatgtttgcccagattagtttaagtgttccaagggtgataaggggcctggtcctgggtataaaagagaggattttggatagaatctgggctagtttttgagactcctgaaaatcagttttgagagaaagtcagtgttgaaagctttaaggttatgttttggtctctttgaatcagtcttagaaatcaatctaggtccttctttaatcagtctttgagagtgttgagaggttcctggagtcctgaaagtcagttttggttggctttgaaaccattctttcagaggtcacacattgaaaaatcagttgaaaaatggtcctgaaaatcagtctaggagggtattctaaatcagctcgtgttcttcttttttgagaatcagtttaaaagcaaaggaaggataggcattcagctctgagtttgttactgtttcattgaaactcagagtgtttctggtttgactctcaagagcttggggtctaattaagttggtctgttaaaaggttgtgtctggttaatttctattttctgtttggtttcaagctgtttctggattgttttgaggttgtcctgtcaactctgtttggttttcaaatattcctgggcattttgactgtggtgtggtattgaatattgattggttgcggctgttggaacttgttgtttgttcatactactgctgttgtttgctgtgttatctgctgcagctgatcttcctctttcttccattgtaacatttccaggtacactttcgaatcacattgtgatgaggctgtgaagtgaatgatgaaataaaatgctcttcccttttgtctcatgagaaatgcatgcccaagctgacaagaatgaatagatagtagttggcttgttatttacttagattcaactctaatttgtgcttatattgtatagttgagacagactttgggactgtgtattttaatggattagcgttagtcattcatcctgatgtaatgtagttttgatcacttagttaactttaccaggaatcgaatgtcattagtcagtgtatgggccatcatttgaatccagcatgataacgtttttttttcagtagcatgttcagtagttcagtggtcttagaatcacagactacttgaatgttggtttaataaagtcagttttaatcaatatagaatagtagttagtttgcttttgctgtcaagtccatgctttatctcaattctcgattttagtaatatgcgctaatagaacaagtaataaaaaatctccctttgtataagctcgagtgcaattttccgttcgcatttgttttaatctaataactaacaagttagggcctttttcaagcatgttaattaattaggcttttttttagagagacaaataatgtagaatatcatagtttactttaggatggacctttaaatgaaatacaagacgagcctcgccaaataaaatgcacaaactgcggggccctcaataaatggttataataaatacttagaattcgggatgggccgtttagcaaagttcaaggcccttcccaaaataacaacgcgttagtcactttaggagcgattttaataacactacctccctaaattcgggtgcgcatttatgcgacccaaatccaaatctcaacgaagtcggaatgtgtcaacgaccacgggtacattgatgtgacgtggttcgagatgcgctttcactgcgttgcaaattttcttttaagataacaaaataatgaaagcggtaaaaagttaaaatttacacataggttcaacatgtacaaaatcagataaataagccgaatatgacagttgagcgaccgtgctagaaccatgaaactcgggaatgcctaacaccttctcccgggttaacagaattccttatccggatttccggttcgcggactgcaatacagagtcattattttcctcgattcgggattaaaccggtgacttgggacaccataaatctctcaagtggcggctctgaactttaatagtaaatcccatttcgattgtcctttaattggaaaaactccctctacgcccctgcgggcgcaggtaaaaaggaggtgtgacagctcttgcgactctgctggggattctaacccagaaccactggttcagggttagaaattcgagcttataataaattgttgtatttggctttatttattatctagttttattatgtgattgagcttaaatgtgcaaaattgatgctttttaccgctttgatattatttgaactgtacatataaactgtgccgaaaccttctcttcccacctccggggatgtgctcactggttgagactccctattctgttagtgtcctaccctaaaataaaagaggctcggataagttactaagccagacgatcttgcgggtccccgattcgtagccccctcctcgactcgagttgtccgctcgggtacattgtttagaacacatacccaggttttgaacatagaataacttgacttcatgctggatccctagtaggaacgcttatttgcatcatgttgcatttgatttagggggcacaacacaggggttgggtccgtctaggacaagcaacctgaaatgcaaaagaccatcctgctacatcctgtttgttttatgcatttatttgcttcggactggcatgctgaccggcttctgaaaatgagaaatactgggaaaactgtgaaaaagagaaaaagaagaagagaaaaatggcagtgtagagagataactactcatttttagaaaaaaccaatatccaaatagtgtcaaaactctgccgaaattttgaaaaaatgaaaaaaggaaagaaaggtgtttatttgaaaaacaaaagagtcttgtttttaatttagtttattttctttgcccgaactacgtcggtttgattctcaccggatgtgagatacgtaggcaaccctcatcggtccaacttccccttttgcaaaaataatcaaaaaatgtcaaaattttaattttcatcataaatgagtcgggcgataccgtttttgtcaaaaatagccaaatgttcccaaaagggacgctggaaggctgattttgcataaacagtcacttttggtcatttttggattgttgaccgattagtccacacagccttaaactcttcatccccgaggcgctgaaaggccgtgattgcaatattgggtcttttactataaattcgaaaacaagaaaaagagtcttaaatgagtcgggtgatgttgtttttatcaaaaatagccaaatattcccgagagggacgccggaaggctgactttgcataaacgaccacctttgttattttttgggccagttgacccatacagccttaaaatattcgtccctgaagtgctgaaaggccgtgttcggaaaaccgagtctttcttttaaaatttgaaaaaaaaggaaaaattagttttgttttgagtcaaataatgttttgctttttgcctaaatcaccttaataaatgtccctttgggtttgcatatgtggcggaatgacttgggagaaccagggcaagacacggttaaattgtacttgggagacctggttgggttgctgaagattaatccgagaggggatatcataagggcattaattccattatgggacccgacacacaatgtgtttcacttctcagattttgagcttacaccaacattggaagaaatagcagggtacatcggaggtcctaaaattcctttgagagaacagtatttgattgctccaagggccgtaaccatacacaggttcttagactctttgaagatacgcagaacggtccacaacccggacatggcagaaggcttttgtactctgtcattcatatacgacagatatggtcatatcggagggttcaacaatccagagagtaaaatctgaagcaaggaaaatcgcctgaaatgggaagaacataggtgctttgcgtttatggtggcctttctgggacttctagtgtttcctagaaaagatgggaaaattgacatacgagtcgccggggtcgtcagtactcagctcactcaagataacagcaccctggcaccaatgataatagccgacatcttccatgctcttactacttgcaaagccggaggggatttctttgagggttgcgatgtattgctgaaaatgtggatgattgaagaacaattatgtcatcaccctaaatttatgagctatgggtcatcgaaaaagacgtgtatagaagaattttctacaagggtcgacgggttcagtttgccagagggggtcaccgaatgggtaacactcctgcgttctgtcaccgcaagccagatagaatggacatttgggtggttatctgtagacgaaatcatacacatgtcagccacataatctcatttgctgttgatggatctcaaaagtattcaaccatatgtgccataccgagtcttgaggcagttggggcggtgccaaatagtcccaaaggacgaagatctcagcagccaggtagtctaaattgggcctaatgggcagttccccgaagcggtagttcgcaaaatctggaatgaacgtcaaaccttgaaagcaaatactcgtgtaagggataggtccaaaggcgaagtgttgccaggatacattgcttggtatagaagagaacttgggctcgaaaggccggctaaaagacctcaccttcaggagtttgccgagtcttcacaagagcattgggattggttagcaagagaagaagaatacagggtagaaattggcaagctgaaacagcaggttcgggacctgaaatttgaaaatagcgtgcaagttgatgctgatacaggtgaaaagaaccaactgacccaagaaaataaggccctgaaagcccaagtccgaaagattagaagggatgccgacaaccaacagagaagtcagtctgacgaaaggctgataagggggttgaaaaagcagattactgaaaaccaagagggtttggaaaggtcggaagctagcatggagaggatccgagccagatgggaaaaaggtacagaagtgcgagcaaatcatatgcggcaaataaagagggattacgaagggaacatggctatattgagagaaacaatatccactctcaaagagcgggtcctcagacaagcccgagattccagaacagataggaaacactgctatgacctaatggcacgaatggagaaacaaatggataagttccaagatcaactctttaacaacgctcaagtgttgggaatgagggaccaacaaatagagcgactacttgtggaaagggacagaatcagggaaagaatcgaagatatagggaactacatcaccatgaggtgcctagcatgtgaggatatgtcccgtgcactttgtttgctttagtgatgagttatgtccaccagatcatggaagatttgaaagatcagcaaaggggccttgcaccaaatcccgcggcgaggccgaacgatgccccgcgggcaccaaaattcaaagctttaatgtattcctagttcgagtctctattctctatttttaagaggttgttgtctgtctgtctgttcattttttgcatcaaattatgtcagaagtttttaggtctgtattctgtttgttttcctttcaaaaagtgtagtcttgtaatagaatcttttgctaatgaaggttgaaaaatccaaaagtggtgtctttattttttcgcattggtgggcagaactacgcacggtctgattcatgcggggacataatacgtaggcaatccacataagcttcgaccaccactaaaaaaggaaaaagaaacagagataaagaaaaaggggggggggggggaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggggggggataatagaaagacaaaaaggaaaaaaaagagcaaagagaaaaggcaaaaatgagaaacaaacaagggaaataaaagttttgaaggcacttaaagggggaacaaataaaagaagtcgggatgacgcatacagttagagcaaagacatgatagaaatggttaaactgcctaggaacattgcatcccaacgtgcaattgcaatatgtgttaaaatctaacgctaacaaagtttgttgttttccagaagattcaaacagttagcttgttagaacgtactggcaccataccattaccaaacaagatctaatgggcccataccgaaaagcatgtctaactcggagaaaagtgttgaggaggaaaagacggaaacgcaaatgctgaaggaggaaatacataggttgagacaagagatgaaagaaatgcacctagcctgggctagggtgaaaaaagtaccaatccctcccactactcctaccctcccaccggtacagacgccgaaataccctccccctggcccatcaacaagcctcctagttcaccaatactattaggggggaaaatgcctatgatccccaagcttcaccactcaatcagaaccatcctccaccaattattcctgtcttcgtggcacccccaccagccacactgcaaatatcatccagtgagccgctgtttcaggctcatgataaccaatacgatcctcctgaacctaccttcaaagcacccgagccacatacttataccactcactttgatctcccggtagaaactgagaggccggctaagagtccggatcaggatgaagtgcttcgcaaagtgaaaagcctggagcagtccttaaggaatatgcatgggttgggcggccaagtcagtgtggcctacaaagatctgtgtcctttcctcgatgttcaattgtcggcaggtttcaaaatgccaaagtttgatctatatgagggacatggtgatccgatggcacatctacgaggcttctgtagcaagatgagaggggccggtgggaaagatgagctgctgataacttattttggtaagagtttaagcgggtctgcgctggaatggtatacaaggaaggatcctagcaggtggtacacctaggatgatctggcgcaatcatttgcgggtcatttccaatataatcttgagatcgtccctgaccgtctcacattgttaaagctggagaaaaagcctggagagagattcaaggagttcgggttccgttggagagaacaggcggtaagagtcgatcctcccatgagggaaggtgaaatggtggactactttttgcagactttggagccaacttactttggtcaccttgtgatgtcagttggtaaatctttcaatgaggtagtaaaaatgggcggtatgattgaagagggactcaagtccaataagataatgagttattcggccatcaaggccaccactcaggccatccagagcggcacgagaggtgtgctcgggaagaagagagaagaggtcgcaacagtcgaggcaggtacttggtccagatccagaggtccttcaccctattaccaatctagaccccaccacccaaattacccatacactccatataaccctccataaccctactacctaccaacagagccacatttttccgtccatcacacccaaacatatacccagcctccggctcacctgcaatggcgtgcaccggctccccaaaatacatacctacctccacaaaacacatatccaccccctcgggcctacaaaatccttcagggacaggtttctgtgggaatcaagcttttaagaatgagagggtgccgaggcaaaaaacatttgcccagttgggagaatcctataataccctttttcataagttgaggcagttaggcctgttgaatcctattgagccctaatttccaaatccccttcctagaaatctggaccattcagtgagttgtgaatattgttcggaggctcccgaacatgatattgagaaatgttggaagctgaaaactgccgtgcaagatcttatcgacacaaataggatcgaggttcaggctccagaggccccaaacattaatcagaatccgttgccagcacaccatgatgcccacatgatcgaactagtgcacaagggagggaagctcaagaaaccctcacagacagtaatgatgatccgcgccagtccaaaagaaaaaccaaccagtggaaaagcagtggtgaagtgtgtggatgacaagccagttgtggtaatggggaaggggccatccattgtggcaaagaaaccagagccggtcaaggtaatgatgcaaggggtatcaagcacacctgtggtagtcatgaaaggggctcgcatagaaccggtggttatcaagccagtaatgcagttgccaataatcaatgaaaaggccgtgccatggagctacactcaagtgatagtgttgtataaggggaaggaagttatggaggaagtgtgtgaagcccaaggtctaactcgttcgggaaggtgttttgctcccgcagagttgagaagggacaatccagcggtgataaagaagccagttaccgaggaagaggcggaagaattattgacgaaaatgaaggcacaagattactccattgtggagcagttgaggaagaccccgacacagatctcgttgctatcattattgatccattcaagcgaccattgccgggcattgatgaaaattctgaacgaagcccatgttccggataagatctctgtgaaccatttggagaaaatagtgcacaagatctttgaggtaaaccgagtgacattttctgacgatgaaatgcagtggagggtacagaacacaacaaagctctctatttgaccgtaaagtgtgaagactcgatagtcactggggtactaattgataatgggtccagtgccaatatctgtcctttgaccaccttgaacaagctgaagattgatgatgacagaattcacaagaacatcgtctgcgttcgagggtttgatggtggtagtactgatacagtgggtgatatcatactggaattgacaattagtccggtcgagttcaccatggaatttcaagtaatagacatggcagtatcatataatcttctgttggagcgaacctggatccacgctgccaaagcagtgccttctacactgcatcagtaggtcaaattcgagtgatatagaaaagagatcgtagtacacggggaagacaatacaggcgccgtaagtgatgccatcatgcccttcatagagactgatgatgacaaggggccatgggtttaccaggtttttgatacggactcagtggaaagagttcctgagggtgaagacattccacttcccagaatagcggctgcaactttcatgatagtctcggagatgctgaataacgggtttgttccaggcaaaggtttgagggttgatattcagggtattgttcagccggtttctttgcccaagaatctggatacttttgggctggggttcaagcctacagcagaagatgtgagacaggcctgcaagttgaagaaaagagtctgggttcttcccaaaccggttccgcgtctgtccagatcatttgtcaggtgaggtatcagaaagttgttggccccaaaagttcttgggccactaattggtgcaagtggaaatttgaacgaaggttttgaaaggttgttcgccgaagtcaacatggtagaagctggggaagggtccagcaatgcggatgtagagtttgtggggccaagggcaaatatcaacaattggatggctactcctcttcctattcgaaaggagtcttggtagtgggctctgattttctttcttgttttttggatcattccagggttgtaatccagttttctttcatttttgtattcggcaaagtgtgaaaccttgttatcccgtattttaataaagtgaaagtttttttcttcattccttattttgttttcttcttttctctttctgaacagttctctttatactggttctaatgacatggcatgcacgatggatcttcaaactagtctaaaaaatcaatctgattccgaactaatggcgcaagaggtagaatatgatgatgaatcggaatacgatgaggatgaagccttcgaagagataaacagagaattaagccagtttgaagagaaacccaagcccaacttaaatgacactgaagccgtcaatctagaggatgcggatgacatcagggaaactaagataagcatccacattgaaccaaacatcagggaagaattgatcaaagcacttgttgaattcaatgacgtttttgcatggtcatatgacaacatgcctggtttaagcaccaatttagttgtttataaattgcccactgacccggtatgccctcccgtcaagcaaaaattaagaaagttcaaaaccgacatgagtgtgaagattaaggaagaagtaaccaaacagctgaatgcaaaggttattcgggtcactcgatatcctgattggttggctaatgtggtgccagtgccgaagaaagatggaaaaattagggtgtgcattgattatcgcaatctgaacagagcaagcctaaaggataacttcacattacccaacatccatattttgatcgataattgtgccaaacgtgagatcgggtcttttgtagattgttatgctgggtatcatcagattttgatggatgaagaagatgcagagaagatggctttcattacgctgtgggaaacttattgctatcgggtaatgccatttggtttgaagaacgcgggggcaacgtacatgagagcgatgactactgtgtttcatgatatgatacacaaagaaattgaggtatacgtggatgatgtgattataaaatccaagcatcaggcagatcacgtaggagacctaaggaagtttttccagagacttcgaaggtacgacattaagctcaaccctgctaaatgtgcttttggtgttccgttcgaaaagctgttgggattcatagtcagtcggcgaggcattgagttggacccgccaaagatcaaatccatccaagaattgccaccaccgaggaataaaaccgaggtaatgagtctgttgggaagattgaactacatcatcagatttatcgctcaactcacagcaacttgtgaacccaattttcggttactgaagaacgatgttgcggtagaatggacggtagaatgtcaggaggtgtttgaccagataaaatggtatttatctaatccacttatgttggttccgcccgaaccaaggagaccattgattctttatctaacggtcctggagaattcatttggttgtgtactggggcaacacgacatcacaggaaggaaggagcaggccatctattatctcagcaagaagtttacagtctatgaggttaagtacactcaaattgagaagacatgttgcgtcctaacttgggtggcacagaaattgaagcattatctgtcatcctatactacttagctcatttcaaggttggatccattgaagtatattttccaaaagcctatgcccacagggagattgacgaaatggcaaatactactcacggaatttgacatcgtctttgtgacaaggacgacaatgaaagccctagcaatagctgatcacttggctgagaatcttgttgatgaagaatacgagccattgaggacgtattttcctgatgaagaagtgatgcatatcgatgaattggaattgactgaggaatcagggtggaagcttttctttgatggagctgcaaatgcgaaaggggtgggagtaggagcagtgcttatctctgaaataggacatcattatcctgtcacggatcaactacgtttctattgtaccaacaacatggctgaatatgaggcatgtattttgggcttatgcttagcggcggacatggatgtccaggatgttttggtcttgagagactcggacctcctggtacatcaaattcaaggtgaatgggaaacacgtgatttgaagctcataccatatcgacaatgtttgcacgatctgtgtcaacgttttcgatcagtggagtttagacacatcccaagagttcataatgaagtttccgatgctttggccactttagcgtcaatgttgcatcatccagataaagttcatgttgatccattgcatatttaggttcgtgattagcatgcttactgtagcatgacaaaggaagaagtagatggcgaaccatggttctatgatgtcaaggagtacctcagaataaggatatacccggagcaggctaccggagatcaaaaggagccattcggcgattggcaaatggatttttccttagtggaggagtgttgtacaaaagaacaccggatttgggattgctgagatgcatagatgctagtcaagccacgacagttatgatagaggtaaattctggagtttgtgggccacatatgagtggatatgtactggcgaagaagattcttcgagcagggtattattggctcactatggagcgagattgtatcagttttgtgcgcaaatgccatcaatggcagatacacggagatctgattcattctccgccaacaaaattgcatacaatgtcagtaccatggatttgttgcttggggcatggatgtcattggaacaattgagccggcagcttctaacggtcataggttcattctggtgaccatcgactatttcaccaaatgggttgaagctaaaactttcaagtcagtgaccaagaaagcagtggtggattttgttcattcccatatcatctgcagatttgggatcccaaagttgatcatcacggataatggtgctaatcttaacagcagtttgatgaaagaagtgtgtcaacagttcaagattacacaccgtaactccacaccatatcgccccaaagcgaatggagcggttgaggtagccaacaaaaacataaagaagatattgagaaagatggtagaagggtccagacaatggcatgaaaagttgccatttgcattgttgggttatcgcactactactcgtacttcagtgggtgtgactccttatttgttggtatatggaactgaagcagtgataccggcggaagttgaaattccgtctctccgaattgtcgctgaggctgagattgatgaggatgcgtgggtcaaaacccgattggagcaattgagtctgattgataaaaagagattggcagcagtatgtcatggccaattatatcaaaagaagatggcaagagcatataataagaaggtccatcccaggaagtttgaagtggggcagcaagtgttgaaacgaatcctgccacatcaggctgaagcaaagggcaagttcgccccgaattggcaagggccattcattgtgaccagagtgttgtccaatggcactttatgtttgacagatgttgagggaagatgtatcgacatggctatcaattctgatgcagtcaagagatattatgtatgatttattttgattgtaattgttgtttgtttatacttggcattgtatcggagaatgaaatgatggaggcaattttttctactatccaaacactttaacctttgtctcccctttttgagccttatctattctttcatacccctctcttggaatcgataatgaaattgaaaaaaagaaaagaaaaaaaagagaaaagaaaaaataacaacaaaacaaaagaaaagtcacaagaaaaacaaaagaagtgtgaactacgttcgacctgatttctcaaagaggatacgtaggcgcctcacggctcggtcatagtgtaacaaaaatcaaaaagatccccaagcaagaaaactggggcagaagttgcgtttgtaattttgggagagaagtttgattccaagagttgtaatgcttcacccatcaaaattattttgaacttttgatacccttttcttttagccatacgaaaaaacccatattgatgtccaaaaagacctcctgatcaatattcgaaaagtgccaagtcaggcaaatggaagtcgagaatcacactctgatccccagcagaaaggggaccataagctgaagagaattgatagccaaaagaatccctagcagagagagtcttatcgataacactccaatccctatctgaaaaaaataaaatgagagagtcttatcggtgaaaaccttcactggcaccataaggcgacagaagttaagagaaataaaatgagagagtcttatcggtgaaaaccttcacaggcaccgtaaggcgacgggagttgagagaaatgagagagtcttattagtgaaaacccctcgaagggcactatgaggcgacaaggagttaaatagggggcaaacaagataagatggacggaaaggatccgtcgaggcatcaagcagaacaaagatgttgattcggcaaaagagttgggatgcgggacctttggagatgcaaagtaaggccgtcagaaagattgattgatacaaatagactgggttgattaatccaaaatgcacgacatgatcattgggatcggttataccattcagataagttcttttcctttttcttctccccaacagttgttcagaaagacttttctttttctatctcttgaagtcatcatttttcatttctttgcttaaagatttttcaatggtggtttgtttttaagaaggattttcatagcttactaccagtttccaaaatggtgcaaggcaaaaatgtggataagacaggccgaagataatgcaatggaacaagaaagacgttcattgcaagaccaaatgatggattagtctaggatttcggggaaagtatggagaaaagcagaaaacaacagttgataaatttgtgaataaagaatagttaagaagcaggagcatccccgacagattatcaaccaagttccaagatggtcggacaacacagagcagggaaagaagaaagggaaaaatcatccccaataggaatattatccccagcaggaatatggtccccagcaggaatatcatccccaataaataatatcatccccaacgagttttgataatgtaatggaacgcagagcggggaaaggagaaagggaaaaaccatccccagcaggagtggcacgaccactcaccacgttttaaactaacaaattttctttaatttgaagcagggaaaggaaatgttattgatagcggaaaagcatgccacaaggaagattaccaaaactggggcagaaaattttctcggaggaacaaggaaatcaattcaagttttaaggggaaagcgagacaacacaaggttcgaagaaagcagtttcagagaaggacaatacaagttttgaaggaagtagttgagaaggagaataacacaaattaaggaaagcagtttgggaggaagttttgagtgaagaacaatgtcgataagacacaatttttgtagttgaagttaggagcccacctggagaatggaggttattatattttaagttgtagtcgaagttagaatcccacctggagaatggaggtagttatattcaagttgtagttgaagtcaggagcccgcctagagaatggaggtatcaaatctttaagtggtcgaagtcaggaacccacctggagaatggaggtgatatctcttaaatgtagttgaagtcaggatcccgcccggagaataaaggtgttatctcttaagttgaagtcgaagtcaggagcccgcctggagaatggaggtattaaatctttaagtagtcgaagtcaggagcccgcctggagaatagatgtgttatctcttaagttgaagtcgaagtcaggagcccgcctggagaatggaggtactaaatctttaagtagtcgaagtcaggaacccgcctggagaatggaggttgttatattttgtagttgaagtcaggagcccgcctggagaatggaggtattatatttttagttgaagttgaagtcaggagcccgcctgaagaatgaaggttgttataattttaagttgtagttgaagtcaggagcccgactggagaatggaggttgtattattttttaagttatagttgaagtcaggagccatcctggagaatggaggttgtattattttaaattgtagttgaagtcaggagcccgcctagagaatggaggttgtattatctttaaattgtagttgaagtcaggagcccgcctggagaatggaggttgttatttttaagttgtagttgaagttaggtgcccgcctggagaatggaggttgtattattttttaagttgtagtcaaagtcaggagcccgcctggagaatggaggtgttatctcttaagttgaagtcgaagccaggagcccgcctggagaatgaaggtattaaatctttaagtagtcgaagtcaggagcccgcctgaagaatggaggttgttatattttgtagttgaagtcaggagcccacctggagaatggaggtattatcttttaagttgtagttaaagtcaggagccggcctggagaatggaggttgttatattcaagttgtagttgaagtcaggagcccgcctggagaatggaggtatcgctttaagtcataattgaagtcaggagcccgcttggagaatggaggtgttatcttcccaagcagtcgttgaagtcaataactcgcccggagtgcggagggttacaacaaaaatcccagcataaatcccactttagaaagaagaccgcaagtcgagtcagaagtaaagaaacaccagagaaacacaaatcaacaagacatcaaggcaacaagagatacaagagcaagttgaagatctagataagagtttgtaattcatagattagtctagctttttgtttttgtttagcacggcgtaataaggagatcgataagcagtggtagcagcagcaacagcagtaacagcaaaattacagttccatggtagtcccagcaaccaaaacttcccgaactacattgacctgattttcttttagccagggatatgtaggaaatctttgaagcagaggtttgggcaaaactttcaaaaaatgcttcacacagagtagtcaaacgggcaaaaattgcttgtatccgctcactttatctttgcacaaaaactctacacgttttcggacaaagaggggaagctgtgagcacgtgatttttgacctatgaaaattacccccaaagaattcaagaataaaataatttttgcgtcgttcgcaattttgtggattttgtgacatttttcttttaattatttgtatttgtttgtgcgtgtttatttttatcttaattaaggaaaaatacaaaaaatatatgttgcatgcatttaggatttaattttacaattaggaattaattaaacaattttggctttacaagaacgaaaatcacaaaaaataatttactgcgcagttttggcattagatgtccgattgtgcgattttgttttccaattgatagtcaattatgtgtgataattattattaagagtcaattagtattttaagttaatttttggtttttgatttaatttagaattttttgtaattaggaattaaaagagaaaacaaaagaaaaggaagaaatgaaaaatagaagagaaaaatcggaccaagcccaataccctaccaggcctaagctctcaaacccggtccagtccatctccgtgcccagccaaacgatgccatttaggcgtctcaaatctgaaccattgatcaaatagattgaacggtccagttaagctcccagcatcgttaaaaggacaccgtttgaggtgtgttgatctgaaccgttcgttccctttgatctgacggtcccaaggcttccccacaacccgactcatttatccccgggtcaacccagtcccccatataagctctaatgacaccgtttcatttaagccattgatctaggccgttgatctcaactgatccaacggccatgatcaaatccctaaccccgtatataagtaacaaaacacaacccatgcccccctcataacaccctaccccttcgtctctgagttcagagacttgaacccctcccctgaaaccctagccaccaccgttcccttcgcctgaatacccggcggcctgaggtccgatgaccctgttggcccaaggttcagttaagttttgaagattgacaaatgaactgatggaaggacctggtccatcttgcactacacagtctgaatcaaccaagtgcacatgagaagcacgtgaggaagatatgcactgaagaccacgcaatcaatatcttctgaacataatcgaaaaggttgcatttgagataaggaaaacagtctccttatgtgaagagaacttaatcctaagttaggataagagttggagtttgtattagctaaggactcgaattgtgtacgagtatgaagtagagtctcaatcaaactctaactactaactcattatataaatgcgttggttctcttttacaggtaacacacacaagctgaagcaaagcatatttgagagcaaaactagcaagtctgatttgcaagcaatatatgcaagttacaggtgtgtacgcctacagctacatgaacctagagaagaaccagttccatctgagtgtttatttctagttcaattgtagtaggttttatattgtacctttcagcttttctagaagcaactgtattaggtaccttgtgtaatcaagttagagttaacttgattgtgtcgcagcagctgaggttgtgtgccacactgggattagagtttaatccttaggtttacaaagagtttttgtaaatgctgtttggctcttgattttagtggaagtttgggaaaatcctactgagtagtaggtcgtggttttttcaccttttgagccaggtgttttccacgtaaaaatacttgtgttatttaatgtctgctatttaaattccgcaactgtagactgtaaaacacctagaagaaccaagttctactagatcgaaaaatcgggtaccatacaaatcacccccatcttgtgtggtattgaagtttattaacatcaattggtatcagagcaggttatccttgaagaggttaacatcttaggaaagataaaaatgagtgcaccacctgggaattgagaaggacagtctactgccaggccgccgctattcaatggtctctactactcttggtggaagaatagaatgagggaccacatcatgggtgaagattatgaactgtgggacatcatcactgatggtcctcttgctacaaccaagaagaatgctgaaggagtagatgttcctaaaactagagctgactgtacagctgaagatttaaggaaatgggagaaaaatgctaaagccaagaaatggctagagtgtggacttggtcctgatgagtacagcaggattcaaagctgcacaactgccaaagaaatttgggacactctagaagtggctcatgaaggaacacctcaggtgaagaggtcaagaggtacactgctctattctcaatataagaattttacaatgaaagacagagaaactatccaagagatgtatactaggttcactactttgacaaatgaactcgagtctcttggaaggactatcctggaagaagacaaggtggaaaagatcctaactagagtgctgccaatcacatgggagagcaagatcacagctattcaagaatccaaaaatactgccacgttcaaattggatgaactaattggaaatctcactgcctatgaattgagaaggcaaactatgaagatggatgctccaaagaatgaaaggagtttggctctcaggatctctgaaggatcagatctcgaagatgatgaaatggctatgataactagggacttcaagaagtatctcatgagaggaaaaggtccttcaagaggaacaaccttcaataaacctagggctcctgagaagcagacaaatgatggttgctttaagtgtggaaagacagatcacatgatcaaaaattgcccccaatgggagattgagtggaagaaagaaagggcagaaagaagaaacaagaggaaggaacaggttcaacctagaaggaacaaaggaacgaccaaagctatgatttctgcaaggggagaaacttgagatgaagattcagaaattgaagatgaagatgagtaagctcttatggccattggagaatcagaagacgaacaagaggtaagtattctacatcttaaagaaaagataaaattcctgtctaaagaaaaattggctgaactcttaacagacttcatagatgagtctaaatcataaacagtgagaaaaatgttctgtctagggactgtgtaatactggaagaaaaatgcaaaaggatagaatccaaggctgatgaaagtgataacttgaatactgagttgaagaaccaggttcttcaactggaaaatagtgtcttggaacttaggtctgaaaatttaaaactgaaaataggaataggaaagaaaaaggctgatcaatcatttctcacactaaaagaaaatctaggaagaatgaaagatgagttatataagaaagacgaatcaataaaagccttaaaagaagaattaggaaaggtaaaacatgaactagacagaacatgcaaatggaacaaggcttctgatgcactctcctggctgcaagaacatcacagcagcaacaagagaggacctgggtttgggacacaagctccaaaatgggatcccaaaaacaagtacctcaacctctctgaaaataagatctgcacacactgtggtaagactgaccattacacaaatgaatgcaatctaaaagaaaaggccagtcaaaagaacaaaacatttgttcaaggaaaaaccaaactgccaggttgggcaaagaaaaatttaattcatccttttgcccatagaaagggacccaaaatggtttgggttcctaagactaacccctgatttcattttgcaggtccaagtgaaaggaagtagccaaatatgatacatggatagtggctgctcaaaacacatgactggtagtaagaactagtttctttcacttgagaacctaaagggaggtaatgtctctttggaaataggaagaaaggtgagatcattggggttggaaaggtaggaaagacagactctcactccattgagaatgtctacttaattgatggcttgaaatatagtctaattagtgtgtcacaactgtgtgaccgaggtaaccttgtagctttcacctctagcaaatgctttgtgattaatcttactactgacaagactgttttgcagggaaaaagagttaacaacatttacattgcagatctgtcaacactctctgaaaatgaactcacttgcctaagtgtgttagtcaatgatcccctcctttggcacaaaagacttggtcatgcaagtctaaatcaattaaacagactagtctttaaggacttggtgataggcttgcctaatatcaagttcaaggaagacaaagtttgtgaggcttgtgcaagggggaaacaggtaaggtcatccttcaaaacaaagaaaatggtaagtacgtccatgacgtaagtacgtccatgacttgatgatttctctagatttacttgggtcatatttctaacatccaaatatgaagcatttgaaatgttcactgcgtttgtaagaaaaacccaaaaacaattaggaaatcaacttgcatccattaggtctgatcatggaactgaatttgaaaatgtaacgtttgctgaattttgtgatgaaaatggaatagatcataatttctatgcccctaggactcctcggcaaaatggggtagttgaaaggaagaataggacccttgaagatatggcaaggaccatgcttctttctagtaaaccacctcatagcttttgggcagaagcaataaatacagcttgctatataataaacaggtgcatgaccagaccactggtagtgaaaactccctatgagttacttaaagggagaaaaccaaacatatcccatctaagggcttttggttgcaaatgttatgtgcataacaatggcaaagattcccttggtaagtttgatcccagaagtgacgagggagtgttcttgggatattcctcacatagcaaagcttataaagtgtttaataaaagaactctatgtgttgaagaaagtgtccatgttgtttttgatgaaactaacactctttctgagagacaggaacatgaagatgaagccattggactggtaagacatctgactgaagccacaaatcaggtcaaggtaggatcaaaagaaggaacatgtgatggaacaggtccttccaccttgagcaatcagacagggggaactaatgtgagaagtactgatcataaggaatctgttcttgaacctgttcctcagcagcaagaaaatgatgaaacattcagcaggaatcagttgattggaaaatcttacaaatacctgagttctcatcccattgagaacattctaaatgatccaacatccggggtcaagactagatcacaactgaagaatttgtgtgcatttgatgcctttctgtctctcattgaacccaaaaatgttagtgaagcactacaagatgctgattgggtcaatgctatgcaagatgagctgaatcagtttgaaagaagtcaagtctggcacttagttcctaggcccaaggatagatcagtcattgggacaaaataggtcttcaggaacaaacttgatgaagatggaactgttacaagaaacaaggcaaggttggtggttcaaggctacagtcaagaggaaggcattgactatgatgagacctttgatccagttgctagacttgaagcaattagactcctcataggctttgcagcaaatatggaattcactcttcatcagatggatgtgaaaagtgccttccttaatggctacctcaaagaagaagtgtttgtgaaacaaccaccaggttttgaaagcaaggaatgccctgaacatgtgtacaagctggacaaggctctatatggtctcaagcaagccccaagagcctggtatgagagattgtctaaattccttctggaacatggctataaacgaggtaaaattgatagcacactgtttccaagggagaaaggtaaagatcttctggttgtgcaaatctatgttgatgacataatttttggggccactacaaataggttaagtgaagactttgcaaaattaatgggcagtgaatttgaaatgagtatgatgggggaattaaatttcttcctgggcctacaaatcaaacaaagtcaaaatggtactatgattcatcagcagaagtacacaaaagaactaatcaagaaattcaaaatggaggaatccaaagaaatagatactcctattgcaactgccacaaagttagatgctgatgaacctggttcatcagttgatcaaaagttgtacaggggtatgattggttcactcttgtatcttactgcaagtagacctgatattgttttcagtgtaggactttgtgctcgcttccaggcaaacccaaaggagtcacacttgactgcagtcaagagaatattgagatacctaaaaggcacaactgatctttgcctatggtatcccaaaggtagtaattttgacttaattggttatgctgatgcttactttgcaggtttcctagtggacaggaaaaacacatcaggtatggctcatttcttgggctcgtgccttgtgtcatgggctactaaaaagcagaattctgtggcactttctactgctgaagctgagtacgttgctgctgcctcatgttgtgctcagttactttggatcaagcaacaattagtggactttggaattgaagtgggatgcataccaatattttattataatattagtgcaatcagtatgacaaagaaccctgttcatcataaaaggactaagcacatagatgttagacaccacttcctaagagacaactatgagaagggactaatctccatagaattttgtgccactgataaacaaatagctgacatcttcacaaaggcattaagtagagaaaactttgaaaggaataggttggaattagggatgattaagatcacctaagaggtcaagttcagagtgcacaatgaaaaaaaaaaattaacgaaaaaaaaaatttttgttagtagttcttaatatctgtgaatattagactaatttctactcagcttaatacttttaaataagtatactcctgtgacatatagttgaatgattcactaatcgcttacaaaatttctattttggcatttgaggcataatcaagagaagcgtcatatgaggaacctggttcatctatatgtgctcatgaagaaagtcaggtacgtttctatactttgcacattcagaaaaatttaatttttaatcatgagcaagagtcctagaaattccaatcgtctcaaaactctatccgttagaagctaattgaaccagtttcattgtcattaggagtctaagaataacggatctcttctcctaaatattagcaatcctaattaatccaaattaattcctagggagaccagaactctaagttgacaagacctctactgacgcctgagattagccttttctgacgcaatgattacccctctttaaaagcctttctaatcatgccataaccgtcacttttctatcataatcactgatcattctctctctctcgtctccacaccctcaaaaattcccaaattttcttgaagccattcacatattcatcacctacaatgactaatccccaagataatccaggaaccccaccaccagcgtcacctaacaccacctcatcctctacaccccctcctgaatccccaagacctagattccgtcggacaaaaatgttagccagaaaagctgttgccactggacctttgagaaaagccataaacgaaaggctgaaggctagtcaaaagcaagaatcctcagcaaaggtcactgattctagttctgagcctgatcaatacatctctgccagcaagggagatgaacctgggtcttcaaaaattgctgctcaacaagaaaccccaactaaggtaagatcctgttatgttccggtggatgtagttacaaaggttgatactaggtatgttctgataggggtggctagagatatttctgggggtggatctgtggaacaaatgaagaaaatgaggaaaaaggtgttgtctatttgtgggagtgggggagatggggtatcacattcaggaggaagtgagtcaggggaggctgctgaagggttggtagatttaagcaaacaaaccgttgaacctagtccatcagtagaggaaaccttggctgatatgatgaaaaatgttggggatagctatgatcccaaaaagcgcaaggcgtcctcactgaaaactcttgttgctacaaaacctaccaagaaatccaaaaccacatcacccaaggttgcttctagggttaggactacaagaagcaaagttagagaaagtgaagctgagttgaagagggcattagaggagagtaagaagaagagaatggaaaaagggaaaggaaaggttggtgaaacctcacaaactgtggctgaggaggaggaacaagtgatggaacaggtccttcaggaaaaaacaaaccactgagaaggctcctactgcaaaatctaaggagctcaggacttcttccaagaagccctcaaaacctgcacctgtagagtcctcacttgccaagagaacaagatctgcctctaaaggcaaacaagtgaaaatgatggaagaagaagaagagagtgatgaagaaaaagaagatgagtctgagactgaacaggacagatatgccaattttggcaggagaaaaattcttaagggaaggctgctgaaagacctggaggagccaggcatgatgaggcttctaacatctctagaagctcaaggttggaaggacatggtccttcagttggatggaaaactggccaggaaggaacttgttgagttcatggccaatggatcagtgaagaatggggtagtgaccagtatagttaggggtgtcaaggtgaagttcaatgctgaaaagctgggggagattctggatattccctgtgaggggtatgatgactacacaaggcagaggtggccttgcttggatgggctgccttcagagctgcagataacaaggaacttctgtgatactaagtcagatgctgaagtgcctgcagctaagcctgtgcaaaagagtgaaatgagacctgagcacaaggtgctctttgagtttgttaacaagtgtctcttgcccagacaggaaagaaggcacactgccaactacatggacctggtgctaatgtagtgtatgaatcaagggaaacaaattaactggccagtgttcatggtgaagctgctggaaagggtgataactggctctaagactcatgccattccctatggatttatattgaccactgtgcttgaacgactaaatgttcctctaaaaaagtgggagatggcatccagcaaggagcactttggcatcaagactcttcaggcatgtgattatctgctcagcacggctcccgttgaacctggttcatctgctaaaacccttgtgaacagcaaagtcaggtccttagttcaggaggctggattgaagggtgctgaaatagctaggctaactgccagggtggctgagttggaagaagaaagaaatgggctaagggctgagcttgccaaagaaaaggagaaaaatgaaggcatgctccagcaaatgtttaacctgctgaaaactcaaccctccagctcttccaagccttaggagtcctgttcttagtgtttagcccagtttcctctcttagtgttcagtctttgttttttgtggttcttggtctgtttttctttttgctcatagttgaaaattttattctatgtttgtggactgcattgtagaaactactctttaatcaatgaatgcagctttttggtttttgttaatcttgttcttaatggttatttttgagttgatttttgattatcttaaacatgtgttcacttgcagttgccccagcggccatgagtataaattaatttcgagaattcacactattgatgcaacttttcgatgatgccaaaagggggaagatattgtgcttaaagttttactctctgaactagtgatgtttatgacctaaaatctgacctccttaaatgataagttaaattattctctaagtgttgatttcagctaagttcacaggttccctgatcacaataagcacagagtttgtcatcatcaaaaaggggaaattgttggcccaaggttcagttaagctttgaagattgacaaatgaactgatggaaggacctggtccatcttgcactacacagtctgaatcaaccaagtgcacatgagaagcacgtgaggaagatatgcactgaagatcacgcaatcaatatcttctgaacataatcgaaaaggttgcatttgagataaggaaaacagtctccttatgtgaagagaacttaatcctaagttagattagctacggactcgaattgtgtacgagtatgaagtagagtctcaatcaaactctaactactaactcattatataaatgtgttggttctcttttacaggtaacacacacaagctgaagcaaagaatatttgagagcaaaaatagcaagtccgatttgcaagcaatatatgcaagttacaagtgtgtacgcctacagctacatgaacctagagaagaaccagttccatctgagtgtttatttctagttcaattgtagtaggttttatattgtacctttcagcttttctagaagcaactgtattaggtaccttgtgtaatcaagttagagttaacttgattgtgtcgcagcagctgaggctgtgtgccacactgggattagagtttaattcttaggtttacaaagagtttttgtaaacgctgtttggctcttgattttagtggaagtttgggaaaatcctactgagtagtaggtcatggtttttttaccttttgagccaggtgttttcaacgtaaaaatacttgtgttatttaatttctgctatttagattccgcaacagtagactgtagaacacctagaagaaccaggttcttctagattgaaaaatcgggtaccacacaaatcaccccccctcttgtgtggtattgaagtttattaacatcagaccctcaaattcacacccctgaaccttctaaccacccttaacacaaatccctatccctttaacctcgaatcatcccggtttgtttcgaatcttcaatcgaagattcgagcaaaaccgtaaatctaccccaaccaggcccgaacttacaccctgtgaccatttgacctccctcattcgcaaaccacccttagtttcccttaaatcaatccgaagctcttcgaattttaaatcaaacgggcaaaacctaggaggaccaaacctagagtcggtccaagggaaaaaggaaactggggttttaatcgactttagtcaagtgttctcagtcgagaacactcgattgaagtccgtttttacctcaaaaggttcatgtcgaaggtcaaactgattagagtttgtttggtttttgattttgaggtatttttcctccccttttctattctatttttgttattgtttatttgtttaggtttgttgtattttgtttgattgatttttcgttatttttgtcgattatcttcttctcctcttcaggtcctttttcttggtccaatttccttctatcaattgacgtaggttatgaatagttttgacgattgatccgttttgtttgtagtccaatagttctcatcaattggtttgatgtcggatgttttgtatgttgatccttagacacttagctttagggctcatcgccaatatactgtcagcgatcctacatcttgtataggtttgatttaggtttgattccctgctcgttcatttgtgtttaagctaattatgattggttccccaatatggttagcttactccctatatctgtgtaatcaatctgaccttagtagtctaatgtatgtggctttgaatcattggttcttatgttgatactatttggtccaatatgaatgcaagcttgaatagattttgatgagttgaatcctgatgttgttttgtattgaattttgttctgatatgcttgttaggagtcagttcatacggctaagtaattgattgataagctgaattggttatagctgatagttttgggacagattaaagaggtcagggtaggatagtaatttcagtagctttaggagggtattttgggatgtcaaaagtttgaaattggtttaatatagatggtctgtcagttaagtactaataaaccattaactaatgtatttggttaatcataattgtttgggaaacataatagcatgggatagttctaagggaaagtgattaaataaatagatgcacataacctttgaactaaaaaaagaaacaagacatagagtagtgaggaacaagggaatcaaaaagaacaagacatatggtagtgggggttcagggagtgtgggcagaatgtttgcccagattagtttaagtgttccaaggtgataaggggtctggtcccgggtataaaagagaggattttagacagaatctgggctggtttttgagactcctgaaaattagttttgagagaaagtcagtgttgaaagctttaaggttctgttttggtctctttgaatcagtcttagaaatcagtctaggtccttctttaatcagtccttgagagtgttgagaggttcttggagtcctaaaaatcagttttggttggctttgaatccattctttcagaggtcacacattgaaaaatcagttgaaaaagggtcctgaaaatcagtctatgagggtattctaaatcaactcttgttcttcttttttgagaatcagtttaaaagcaacggaaggataggcattcagctctgagttttttactgtttcattgaaactcagagtgtttctggtttgactctcaagagcttggggtctaattaagttggtctggttaaggctgtgtctggttattttctgttttctgttgggtttcaagctgtttctggattgttttgaggatgtcctgtcaactctgtttggttttcaaatcttcctggcattttgactgtggtgtggtattgaatattgattggttgctgctgttggaacttgctgtttgttcatactactgttgttgcattactgctgttgtttgctgtgttatctgatgcagctgatcttcctctttcttccattgtaacatttccaggtacactttcgaatcacgttttgatgaggctgtgaagtgaatgacgaaataaaatgctcttcccttttgtctcatgagaaatgcatgcccaagctgacaagaatgaatagatagtagttggcttgttatttacttagattcagctctaatttgtgcttatattgtatagttgagacagactttgggactgtgtattttaatggattagcgttagtcattcgtcctgatgtaatgtagttttgatcacttagttaactttaccaggaatcgaatgtcattagtcaatgtatgggccatcatttgaatccagcatgataacgtttttttttcagtagcatgttcagtagttcagtagttcagttgtcttagaatcacagattacttgaatgttggtttaataaagtcagttttaatcaatatagaatagttagtttgcttttgctatcaagtccatgctttatctcagttctcgattgtagtaatatgcgctaatagaacaagtaataaaacaatctccctttgtataagctcgagtgcaattttccgttcgcattttttttaatctaataattaacaagttagggcctttttcaagcatgttaattaattaggcttttttttagagagacaaataatgtagaatatcatagtttactttaggatggacctttaaatgaaatacgagacgagcctcgccaaaaaaaatacacaaactgcggggccctcaataaatgattataataaatacttaaaattcgggatgggccgtttggaaaagttcaaggccctccccaaaataacaacacgttagtcactttaggcgcgattttaataacactacctccctaaattcgggtgcacgtttatgcgacccaaatccaaatctcaatgaagtcgaaatgtgtcaaagaccacgggtacattgatgtaacatggttcgagatgcgctgtcactgcgttgcaaattttcttttaagataacaaaataatgaaagcggtaaaaagttaaaatttacacataggttcaacatgtacaaaatcagataaataagccgaatatgacagttgagcgaccgtgctagaaccacggaactcggaaatgcctaacaccttctcccgggttaacagaattccttatccggatttctggttcgcggactgcaatacagagtcattattttcctcgattcgggattaaaccgatgacttggaacaccataaatctcccaagtggcgactctaaactttaataataaatcccgtttcgattgtcctttaattggaaaaactccctctacgcccctgcgggcgcaggtaaaaaggaggtgtgatactagacagcaacgtatagatactcgtcaccatacctatacgtcgtactcactattcgcacataacaagtaagactcaactcctaattccttaagctaaggttagaccaaacacttacctcgattattgaacaccactcaagtctcagttaaatctttacctcttgattctaccacgaatacgctcaaatctagtcataagttacttaatcacattaataaatgctaaatgaatcaaccccaatgcatgaaaataagttttacaaggttttacccacaaaggtcaaaaatgccctcggacccacgtggtcaaaactcgaggttcggaccaaaacccggttacccattcccccacgaatccaaatatatgatttgttttgaaatcgaacctctaattgaggtccaactctccaaattttagaaaacctaggttctaccccaaacacccaatttccccatgaaatccttgatttgaagttgaaatcatgttaaaagatgttaaggagcgaagaaaataagttagaaatcacttaccaatcattttggagaagaaaaattgtttgaaaaattgcctattatgttttggggttttgaaaagtgaaaaataattgaaattcctgtttatttatacccctctgaagctctctgtgcggaccgcacaaaaaggactgcggccgcacaggcctcctgaagacttgtagatcatttccccatgcggaccgcacaaagccgaccacggccgcacaacatccaccgcggaccgctgccgcgctgacccctccgcggccgcatgcgatttcttgcggaccgcgcaagagggtttagagacctggaatatttcctgcacctgcaacatctgatcttttaagcctaaggcatccctgaacccactcgaaactcatccgagccctcgaagctctaacccaagtatgcacactacctcaaaaacatcctacgaacatattcgtgtgatcaaatcaccaatataacatcatgaacatcgaatcaaacctcaagatcaataaaatttctcaaaactccttttaaacatcaatttcccaattcgggtccggatcacgtcaaacgatatccgtttttaaccaaactttatatgagtgattcaaaacatatataacacttgcaccgggcgccggaaccaaaatatgggcccgataccatcattttctaatcagatttcatttcaattttcttcaaacgttttcagaaaataatttcacttaaaaattcatatctcgggcttgggacctcggaattcgattccgggcatacgtccagtcccatattttcctacggaccctccgagactgtcaaatcatgggtccgagtctgttcacccaaaatattgatcgaagtcaaatttgttcatttcaaagtcaacacttaaaaattttcacaaaatttcacatttaagctttccggctacgcgctcggactgcgcacacgaatcgaggtgactctaaaggaggttttcaaagcctcagagacacagaattcaattaaagtaggtgatgactctttgggttgtcacattcttcacctctaaaacaatcgttcgtcctcgaacggacagaagaaggaagtacctgggtcggggaaaagatgaggataacggtcccgcatatcggactcggactcccaggtcaatgcctcaggaggctgacctctccactgaacacaatccgaaggaaaactcttcgacctcaactggtgaacctgccggtctggaatagccaactgctcctccttataagacaactccttgtccaatcggacaacgctaaaatataacacgtgggatggatcaccatgatacttccgaagcatggacacatgaaatactggatgcacagctgataagctaggcggcaatgcaagtctataagccatctctcccactcgatcaagaatctcaaaggggccaatgaacctagggctaagctttcccttcttcccgaatctcatcacacccttcataggcgacactcagagcaatacccgctcatcgaccataaaggccacatctcgaaccttgcagtctgcataactcttctgcctagactgagccgtacgaagcctatcctgaataatcccgaccttgtccaaggcctcttgaacaaaatctgtacccaacaaccgagcctctcccagctcaaaccatccgaccggagatcgacatcgcctaccatacaacgcctcgtaaggggccatctgaatactcgactggtagcagttgttgtaggcaaactctactaaaggcaagaactgatcccacgaacctccgaagtcgatgacacaagctcggagcatatcctccaaaacctgaatagtccgctcggactgtctatccgtctgaggatggaatgccgtactcaactcaatctgagtgcccaactcttgctgaaccgcactccagaatcacgaggtaaactgagtacctcaatccgaaatgatagatgcaggcagaccatgaagacgatcaatctcccggatatagatctcagctaacctctcggatgaataggagaactgccacaggaatgaaatgtgctgacttggtcagcctatcaataatgacccatattgcgtaaaatttcttcagagactgcgggagcacaacaacgaaatccatagtgatctgctcccacttccactcgggaagctcaatcctctgaaataatccaccaggcctctggtgcttatacttaacctgctgacagttcaaacatcgagccacatataaaattatatccttcttcattctgcgccatcaataatactgccgcaaatccttatacatattcgcggtactcggatgaatagaataccgggagctatgggcctccgctaagatcaactctcgaagtccgtcaacattaggcacacaaactcgcctttgcaatctcaaaactccatcatcatgtaaggtcaccttcttggcacctccacgctgcaccgtgtctttaaggacacacaaatggggatcatcaaattaccgatcacgaatacgctccaataatgaagaacgagcgaccgtgcaagctaaactcaactaggctcagaaatatccaacgtcacgaatcgattggccaagtcctgaacatccaaagcaagcgtcctctgactaaccaaactataagcaagactacccatgctggctaactttctactcaaggcatcgaccactacattggcctttcccaggtggtataagatagtaatatcataatccttcaacaactctaaccacctcctctgcctcaaattcaactctttttggttgaacagatactgaagactcttgtgatcaatgaacacttcacacactatgccgtacagataatgcctccaaatattcaatgcgtgaacaatggctgccaactctaaatcatgaaccggatagttcttctcgtgaatcttcaactgccttaaagcataggcaatgacctttccatcctgcatcaatactgaaccaagcccaacgtgagatgcatcataataaactgtataaggccctggtcctgagggcaaaaccaataccggtgtcgtagtcagagccatcttgagcttctgaaagctcgtctcacactcgtccgaccatctgaacatggtacccttttgggtcaacctggtcatcggggctgcaatagatgaaaacccatccacgaaccgacgatagtagcctgccaatcccaagaagctccgaatttctgtagctgatgctggtctaggccagttcttgactacctcaatcttccccgtgtccacctgaataccctctgccgatacaatgtgacccaggattgcaactgaactcaaccagaactcacacttcgagaacttaaaatataactaactatccttcagattctgaagaaccactctaaggtgttgctcgtgctcctttggctgcggtaatatatcagaatatcatcaataaagactatcacgaacgagtctaaataaggcctgaacactcgattcatcaaatccgtaaaagctattggggcattcgtcaacccgaacgacatgaccaagaactcataatgcccgtaccgagtgaggaaggctgtcttagggacatcggatgccctaatcctcaactgatagtagccatatctcagttcaatcttggaaaataccctggcaccctgaagctgatcgaacaaattgtcaatcctcggtagtggatacttattcttgatcgtgaccttgttcaactgccggtaatcaatgcacattctcatcgaaccatcctttttcttaacgaacaacaccggcgcaccccagggcgaaatgttaggtctaatgaaacccttcttaagaaagtattgcaactgttccttaactctttcaactccggcggggccatacgatatggcggtatagaaatgggctgggttcccggagccaaatcaatgcaaaagtcgatatccctgtcgggtggcatacccgaaaaatccgaagagaaaacctcaggaaactcacgaaccacgggcatataatcaatggagggaacctcagcactagaatctcgaacatacgccaaataagccaaacaccccttctcgaccatacgccgagcctttcacatacgagataactgttgcgccccctttttctcactaaaacgggtttatgatatttgggaggacaactcgttcccttttgggaattgggtttggaattgaagagttgccacctaatgattaaagtgcattaggacactaagaagggtttgagttgaagaaccagagtttgggtaagggctagaaatcatcccaagggaaaggtgttaggcacccctcagtatccactagtatggttcccggccgtgttataattgtgacttcacataacaagtaagcaaataatggctcaaatagaaggagttttcacataatattgcaagtaaattgaaatttgagaaagataaagaaagcagaaattttaagaaatagtttgaacaaatctgaatatgaacaagtaaaggggaagggggaggggtcctaggtttatgatcaatatggatcacatcaatgcaatacccagtaatcactcctcaaaagaggggctacatgaggtattagcgcaccggtcatcatatccatatctacccttcccaccccgttaaggtattaaagcgcggaatagtatcattacttattgcatgctattgcccgtccaaatcctatgagtcccggaggcatttaggactactaatcctaaagggaaaggagttggggctttttagagtttaaaaggataaaagtctaaggtgacaaacaaaacatataaaatagttagggggaaatacatagcaatttaaagtctcaaacaggcctcctcacttaaaataacacattgtttagcatgacttacacatactggttatggtctgaattaaacttaacattaaggccggctgattcatcacatattttcagataagaactccgaattaggcatgtctactggttgtaattatcaaagactgttgcaattaattaattacctagtggcttgcctaggtgaaacttatagccatgatatctaacactgctgagaccgtactgatttactaaaggattactgcttttagaaacaaaagttctatagattttaaacgacattattactaattttagacatgtagatgaaatagacgaatctgattcaacgggttactcttataggcatgatttctaagtgttattgattttaaaacgattatcgggatgcaagtatcctataggcatggtatctaggatgcaacttgttattttttaacctataaactgtttgcctaatgacatatgtatatgcagaagtgcagaaacttatagacatggtttctaaatgcagaaatgcagaaacttagagacatgttttctatttgcagaaatgcagaaacttaaagacataatttctatatgcagaagtgcagaaacttataggcaagatttctatatgcagaagtgcagaaacttataggcaaaatttctatatggatatgcataaacgaaaataggttgtgattgtagaagtaaatacctaaagcatgatatctacacgtatgcattcatgagtgaccctccccttttcactagaacctcatagttattacaaattattacagaaccgaatgaatcaagaaagataaaaattacatcagaaattaaaaattccaaccaaggagagcctaattcagaccccagttttgaaatatgaaataaaccaacttccaaagattaaatttccaaagcctttctcttatttgggatgtgtcaaagttcccaggagcctcaagtggactccaggcagtgcttacaccccaaatatattgcataattagattatagcagtatggacgggccagccctcaagtgttcaagttcagagggaactcaaggtcccaaggcgaggcatataggagggggccgaacttagagtctaagagtaagtgcaagtacatagagggcattcagggaaatccatggcaggctgccagcaattaggaatgctggcacacccctgaccagcctgttagccaaatcttagaagttaggatccattgaggatcaggttctgacctgggcagcaatttgaatactgccaggccatgagccttaactcaaacacatagaagagagtaggggtatagggaattcataacaaacaacagatgcaaagagagagtaacatacatagttaacattaatcactaaacatgaacaacaaagtaaacaagattgcagaaactgtaaataaataggggtgaggctaaaaagttaaatcagaacatactagtttctgggaaaacaaacaagcaaaacagtagtcctgaaaagtcaagttgcaagcaaaagttccaaaagatcccagaaaaagaccagatttttgaatgagtattgaaattgcaagtgagtaatggatactcgagtattgaactcaaagaagtattgtaagtgtataagtaagttgaaagttgcactgaagtttcaaggttgaaattggtagttaaggatgatcaaggtgcagaagggtcgtgccccttttacagtgcagaaaacaagtaagaaaaggtaaggaaataacattgaaatcaatctccctttagttaagggattctgatttaacgggtaaaagacaattaaggaaatagttaatcaaaaatattttccaagtagtacaataaaaggtaaatacatagaagttatttaaggcaaaattccgatggtacacggttggtaaaaaaggaaagggaatcaatcaaacaaccagtaaaatcaaaattataggcttaattcgaatgaaccaagtcaggaataggtaaagagggttcaattagagacaatcagtaacaatcaatcaaaccccattaaaggatttcagaatcaattaattagttggccaaaacctttttttgcaagaagaaattctcatataagaagcagacaaatcaaacaaaaagagacgtcatgttacttagaaaaagagtctaacattgaaaggtccagaatcataagcaaaggggtacaagttcagtttgtagactcatagtgagtctgagagttcagggtcccaactcgaacacaaaaatcaaaatttccaacggaaaccctaaatactagggtttcaaattgaatcagacatagagatgaaaaggcaagccacttgatagaggctcagaagtctttttcaaagacttatgagaaacaaacagacatgatacaaagaaagaaaactgattcaaggtcatggagaacatgtttgagaaaactcggaatttaaacaagtttagaagaaagagatgatatgaacaaacagagtttagtaaagcaaaaatcaaagaactcaaccgtaaacacatatagtagaaacataataaggattaacatgtgagcacaggagtaacatgtatagtaaaagaagaaaaatagaagcacagtacatgcgtaataaaagaaatcacacgagcatgatataaaaaaacacacataaagaaaagaagaagaaggaatggaaagatgtttttgaaaaacctttcagaaaccctaaatcgaagacaaacgattttgaaaagaaaatttggggaaaatactttaaatgtcaagtaaagcatagatacaacatagatctaggaaaaacaaacagagaaagaacctcgaatagcttagagtttctagaagtgagaaaaggcttggaagaaatcagatcttgagtcgaaaaggtcaggaaaggctcatagtgcttgaatataccgaaataaaggccggagaggccatggaactacagatatgaaaggatctgaaggagaaccgttgaggtttgacttcaaaaccttgaacacccaaggtctaatggtagagaggggtgagtacagaccatccatggcatgagaagccatggattccggtgaaaacatggtgaaataaggtaggaggaggctagggttccgaagtgttgttgagaagatttgagagagtttgggattcaaaggcggctgagaggtggaaaatgaggtattagggtaggtcattaagggttaaaaatggtaagggggatttatggccgttgatcaatatgatcaacggcctggataaaaaataggaatcgagcggaatttttagttgggtcggggccgggtaaaaaatgaaattggggcggatttaattggggtagaattgggtcaatttatgggctacaattgaaatgtaaaataggatgtaattgaaataaatgaggccaaatgttaaatagccagttttccctttttattttataaaaatagtaaaaatgattttaaaagcaaattaaaagtactgaaccaattaataatatataaatattaatttaaaaatactggaccaattttacaattataaaatgctattaatcttaaagtaggctataattgcaattatatgcaatttagtcttttaaatacaaaataaatttgtaaaaatatacaaaaatcaccaataatgataatcctggaaataattattggattttgtactgctaaaattgacaataaattgattttaaaaattggaaaaaaatactaaaacacttggggatgcttatatatacatatatatgttataaaaaatacatagggaaaattgggtatcaacaactacgggtagaatgaccaggagtccctctccactctaaacgaggcatacccggtaaggctaaggtcacggtcttggcatgacagtccaagatagcatggtaaggcgataaccagtccatccccaatataacatctaaataaaccatgtctaaaagtaataaatcaacacgggtctcaagacccccaatcacaacaatacaagaacgatggactcgatcgaccacaatagaatcacccaccggtgtagacacataaatgggtacactcaataaatcactaggcatgaccaggtatggtgcaaaataagatgacacatacgaatacgtagacccagggtcaaacaacactgaagcatctctatcacaaaccagaaccgtacctgtaataactgcatctgaagactcaacctcgggcctggctggaagagcataacatcggggttgggccccaccaccttgaacgacatctctgggacgccctgctattgtctcgcctccactgctggcaacctgagctccacctctaggacctctacctcgacctctagcacctttacccctacctctagctggctgggcgggctgaggaacacctggtgcctgaaccatggcacgagaaccctgatgctgagaaccactcggtgctcgaggacaaaatctagcaatgtgacttggatcaccacaagtgtaagaagccctcggctgctgagactgctgaccctgtcgacctgaatgaccacctcaaaaactctgaagcggcggtgcactgataggagcgggtggtgcactgaacaattgttgatcagaaaattgcatatggggaccacagctacctgaagcatcatgagaaacctgaagagctgactgaaagggcctaggaggatggcctctaccataagaatctctacctccagacgaggtaccactaaatcggcctgaaagatgaggcctcttgtctgacccataaccacctccgtgtgacagaaccatctcaactctgcgggccacattgaccgcctcaagaaaagtgatctcactcccggcctccttggccatctgaagacgaatcggctggataagaccgtcaataaacctccttaccctctctctctctctctctcagtaggaagtatgacaagagcatggcgagctaaatcgatgaacctggtctcatattgggtgaccatcatggaaccctactggaggcgctcaaactgcctccgataggcctctctctgagtaacggggacaaacttctccagaaacaacactgaaaactgctcccaagtcaaggctgacgatccgactggtctagccaagcaataatctctccaccaagtcttggctgatccagacaaacgaaatgcagcaaaatcaaccccattggtcttaaaaatgcccatgttgctgagaaattcgtggcatctatataggaaatcctagggatcctcagaagaagcactgctgaaagtagtagtgaagagcttgatgaacctatccagcctccgcaaagcatctccggacatagccgctccatcgtcggtctgagccatgacacccgactaaattgctgcaactggcttcacaactagagtctgaatctggggagctacctgctctggagtacgagtagtaggagtctgggctcctcctccagcctgagaggtggctggtgttacaagaagcaaaccttcccgagtgacactctccatgaggcgcactaaccggaccagagcattctgaagaactagggtagcaataaacccctctgggacctgagctgggcccaccagaactgttagggctggaacctcctcgtcaaaatcaacctgaggctccgccactagggctgctgctcgggggctgagctctgcccctacctcggcctctgcccctcgtaggagctgctgttgggggctcgagcttctgagcggtagatacgtaagcacgtgttctcaccatctgcgaaagaacaaagtagaaattcaatcagtattgggaaacagaaccgcacgacaagaaagaacaaatgagaagtttttcttaactctgtagcctctgggggtaaatacagacgtctccgtacccatccctcagagtctactaagtttgtctgtgaactgtgagacccatgtaacctagagctctgataccaacttgtcatgacccggattttccaccctcgggagtcgtgatggcgcctactaatgtgagctaggcaagccaaaccttaacaaattgctaacctttttcatattacttcttttaaccaacatggaacaacaatataataaaaatgaaattttatagaatttaagcggaagtcttcaactaattaatcaagccatatatattacaactttaagactcaacaccccaaaatctggtgtcacagtatcacagaccgtctaagagtcactatttacaaactctgaaaaagtacataaaactatttctgaacaacaataaggaaataggaatggaatagagggggacaccagggtctgtggacgcctgcaagtctaccttgcgtctccgagtggactgaaggaagcgctccaactaatgtccgatagctactccgagatctgcacacagtgcaaattgtagtatcagcacaaccgaccccatgtgttggtaagtgtctatcctaacctcggcgaattagtgacgaggctaggaccagaccagcaaataaacctgtgcagtttaaatatatacggcaaaacaggaaatacagaaatagtctaacaatgtgggaaagggaacatgcggtggggagataacagtttcgaataaagacaactagtaaggaaagaaacaacataactcgaatacaaatgagaaatcagtaaatcaatacttacacggcaccacccttcgtgcttttactctcttcctcaccaaaacaatacaaggcatcacccttcgtgcttttacctcacataatcatggcacagaatgatgcttcgtgcattaacactcatatcatggcacggaatggtatatcgtgcggcacaacatcaccattcgtgctttacatattctcatcataatcatacacggcatcacccttcgtactttacgctctttcctcacaaacattaatgcacggtatcaccattcgtgctttatcactcttcctcacccaaacaacaatcacaaataatggggtgaggggataaacaatattatactaagaatcccggcaagggaacaacaatcaaacaactaaatcccgacaagggagcaataatcaacaatatcagcttcccaacaagggaacaatttatacctctttctctttctttcactttaatttcataactcattctaacacttgagccaatgatccaaagtgtgcaattatcttatcaactctcacaattcgtattgtaacttgagccaacgctccaagggttcaatcaacccacttgctttcacaatttcataatataacttgagccattgctccccgatgttcaagaaccataattacttcattaactttccacaacaagtagaaatcaactttaaagcatggattatttaacacattcatgaagtttacattataagactcatggttatgctagacacttgtcacgacccaaacccggtcgtgatggcgcccaaccataaagctaggcaagcctgaccaataatcactcgaaagcctaacaatacatctcattaccgacaatttaagggaatttaacagtttagaataataatctgatatttatagtaataataatacggaaagaaccaaaatatctgacaaaacactcccaataggatctggagtcacgagtctagagcctctaaaacaagctaaataacaacatccgaaagaaaatacataagtctggaatgcggaaataaaactgaaataagaggagtggtcgggtcctgcgaacgtcaagcaactacctcaacaactctaatataactctgggagacagcgactgctcagctaagcctccggaatacctgaatttgcatacaaggtgcagggagtagggtgagtaataagtatataatgtctgaagataagaatctacgaaatgccacattgtaaagctaaagctaacagtccgacacaattaacgatgaaccaacagcagaacaacatcaggtatatcagataagtataaatgcatgaatgcaatgcaatgcacatgaccgttgcggcgtgaagcccgctctatttgggtacccgtgctcactgggggtatgtactgtgacgacccgacccgtcgtctcttgtatctctgtctcgttatccccgttatatgttttcccgtgtgttgatatgcgtgttgggagagtttgaaatggtttgggttgaagttggatagaaatgagacaaatagtctcttgaaggaaagcttaagttggaaaagtcaaccggacgttgacttgtgagttagagggctcggaatggatttccgatggcccgactagtttcgggggatgatttgtggcttgtgtgtgaaaatggaagtgaattcggagtcccggtgtgaaagttagcctactttggcgaagttggaatttcggagaaatccggtggataggtgagaatttgatccgggggtcggaatggaattccgacagtggcattagcttcgttaggtgattttggatatgtgtgcaaattttcaggtcaatcggacatcgtttgggtggtttcggcaccggatatgaaattggaaagtttaagtttaattagaatggaatttaaggatttttgatggtttttgatgttaatgatagcgtttttatgatccgagcaagtttgaatgatgtgttagaatgagtttgtgtttttggttgaggtcccgagggcctcggggtgatttcggatgttaaacggattgatttttggttgttgaaggctgctggaattgcagcaggtgttgcagttctatgcgatcgcagaggaccattgcgatcgcatagaaggatttggagggcctgtttggttgttctatgcgatcgcaggaggcttatgcgatcgcatagaaggttcagaggaggtggtcagtttgttctatgcgaacgcaggagtgcaatgcgttcgcatagagttgttgctgggcagtcaagatttgttctatgcgatcgcatagaggctttgcgatcacatagaagggcgtatctgggcagaatgtgttttaagcttagttttgtccgcgaggctcattaagttttccaccatttgtgaagcaccttgagagctaagtgatcaattttgaaggggatttcaccgggaagtcattggaggtaagtctcacgtcattattacgtgtttttatcatagaatcaagcttcaaatatctgaaattgggtgaaattaatgaagaactagggcttgggatttcaaatgaagatttgggatttggaggagcaatcggactccgattttgatgaacttgatatgtacggactcgtggcgagacgaggattccgaaaatgtaagtttcgtaatttttcgagaagcgggcccggggctcgggttttgctagtttcgagattttggctatttcttggttgttttcgattgggtattgtcccattggcattttgtgatgtattcgctctgttgttgcttagatttgacgcgcgaggaggtcggattgagaggcaaaggcattgcgggcttgagatttcgccggttcgaggtgagtaatgctagtaaatgctgtctgagggtttgaaaccccggactttcacatcgtaacgctatattgaggcgtgactcgcactcctggatatgtgcggagtcggatgttgttggggattgtgacttggtccatcccgagtgagatttatagtatattggcgtatgatacgcacactgtgatgattattattgggctatatgccgtgtttggggcctagtgccgacctgtgatatccttcgggagttgatactactgttcatcgtgattgcatatcatatcatatcagtccatgacttttaaagcattgttttcaaacccagccgtatttcaaatgttcaaactcacataatatcttttaaaatgtatttcggctgaggatcatgacttataactgcccaagtggcttatgagacatattttctggactgattttggtggctcggactgtacgccacggcaggtattggattgtatgtcatacgcattgcatcgcattgtattgcattcatatacacatgcatagttggctcggctgcacgccgtagcggtgattggaccagtggtaatacggacactgtgtcgtatgagcggtcagggtaacatggactgaccggggtattgtttggaccagtggtaacatggacactgtgtcgtatgagcggtcagggtaacatggactgaccgggttattgtttggaccagtggtaatatggacactgtgtcgtattttgccaccacgagatggctgattattgcgcttgggctgtaggagcccctccggagtctgtatacacccccagtgagcgccgtcgacgttaaatgatgggtaccggagagtaccggcatttgcattgcatagcattcctgcatttgcatcttacttgttgttcagctttgctcagtttcagatattgttacatatattgttctttagcttgccttgtgtatttctgtgttttcttatcttcggactttatttactattattactcactgggtcggagtactcacattactccctgcaccatgtgtgcagatccagggtatgctcaggcggattagatcctgaagcttttcggcatcagcagttcggagcgttgagatagctgcacggcgttcgcagccatcgaccctccttccctctatctttatttccaacattacttttgtattcccagtactaaacagttatgtatcggattgatcaatatcctagaggctcagacttgtgacaccggttcctagggagtttttattgatattcagtatttgttccgtctgttttggtacctagatcttgtacattttgagtttatcttctcttttgtatctttcatttgagattatgggtattgtggtcgggcttgcctagccttacggccgggcgccatcgcgaccgggatttgggtcgtgacaacttggtatcagagcctaggttacttggtctcacgagtcttgagccggtttagtagagtcttgtggatcggtgcgtagacgtccgtatcatatccacgggaggctacagaactgtaggaaaacacctcacattcatggaattcttatcgtgcgtatttgattcagttggggatataacttttgaaagattccttcttcacgtttgtatgcgcccgtgagcgcccagtgctatatgtgccttgatggctggtgatctccccggttgaggggcgagtgatgatttctatgagttgatattgggccagtctggaggacttgaggcggaatctgtgtctacagcttgagcaccaaggtgctgactgcgcgagctagtgtgatgagcttataagttcagtttagtccccgatttgcagtaatggcggcagaatagctacatgatgattatgtgggtgctgtgtgatgtgcttgtatgattgggagtgtgcgtgtggtggcatgaggccagactcaggaagaccaattgactgcgtgaggtgtatagcggtggatgatgtaccgaaatattatattggaacaaacaggtgagttagcttctgcggattcttctgaagtggtatgaccattatgcgtatgtagaaggtcttatgtgtaattaaaaggtattttctatatgttatgattcgatcaggtgcaatgcatgttcatgtgtcagttttgatgaaataatgtatgtagtattgagatttatgtggttgatatacattgtgatgtcttgtcaagttgtgggcgtgttgttaggatggtttggtgattctctggcaggtggataggctcaattacaaaggaaactctgccgaaatttttggaaaatttgggacttagtggaaattttgtcgccttaagagtggactcaacggttgtgtgaatgaatgcaaaagttgaagaagagttgaaatttcggatgaattgtgtttccacaagcttatggaagagtgagtttaatctcgccatgatgttatgatggctatagagtgtgtgttttaatatatctggcttcgagctaagttggggaggttgctgttgagtagccgtctgtacggttatgtactatgattggttccgatgtgatgaatgtgtgtgaatcagtgctggttgcagaaagtgagccgagggtggcgcgagtgaagcaaggttatatggtgtttcgtatgggtggtaaaagataagagcaagtcttaagttgatggtaaggaatgtttagtgttaagagaatgaagttgttgagtatatcagaatgagatcatgtcctgtggtgtcagagtgtcgataaggcacgaggggttcgattcgttaagttaagtaaattgcagtaggcataagagtggatgacttttgagaagggtttcgatgtgttcaagaatctatatgtatcactcaggtgttctaaggttgagtatgcgatctagtcagtattttcattggaacaggtcaagacttatggtatttttatgttgattgcgaggttctaagaatcggtattcgggatgcgttggcaactaaatcagagtctcaggaagttctttagaggagggcattctgaaatacgagtgttactggagttatacggaagagtatctagcgatttgtggatttcagacagtgtggtttcatgtgtgggtctcgtgtggtaagtatgggttgagagattggggtgctacagctaaaggaaataatgaattgaagatgtatcagatgggaatctcggcaaatgaagtaactcgttggtggtctgaatcggtatggcaaggatatgattggtgctcattgtgtaattggggtaatggtttagcacaggtagatttcgcagcaatgctcttgaatgtggacgattctcttagtgtgttgtaataaaaagggctcagtcatggcagtttagatgtgcggatggaatttgggagagttctggtggattaatacatgattgaagaggtgcattttctacggatgtgagatggtatgtgatgtataataattttcttctgaatgggatcaatgaaagttctagattggttgagtgcgtcgatgtctgcggcgcagaagagagatgaaagtgctcgtgttattcttggaggatattgtgtatgcggcatgttgtaaagggccgaaatggtcatgagcgagttttcgactcagatctgagaagtatgggggatttggctatgtcttaggcaatgagcagcctcaagtaatcaaggaaatggtactgtttaaatgaaagtgatttggcaatagcgtatgtttcgaaaagagggtaattccacaaaatgatacattagtagggttacggcagtttcttatgggatcgactgcggatatctgagttgtttgatggcgagggagttttataatatctctcgtggaatagttgggtacttgaggtgtaatctgtatttcgcattgtggaaatttggatcaggtgcagtgattcgtgtgttatggttagttggagactgggagttctccggtgtagtggatgtggatcgtggatgttgtattggtactaccagcggctattgggagattggaatccggacggatctttccttgcttcttatgctaagctttggatatgacatggggatgtagagtgattgcatcagtattgggttatacgactcgattgtgctatgagtcatgttgggttatgccacaggttgcgtggcgaggtgtatcgaactatgttatagctggatagttgtgttccagaggctagcggtcggatgggaagaattgcattccttaaatgggccttcgaggcggatgtcagtatagaagtctctaccattgatttcggttccagtattgagagacttgcagatgcgtcctagtggccgggcatgtcgccgggcgggacggtggatttcagtagttatctggtgccaggcaccatatcgtacggcttcgtcatgagttatagtaatgaaagtggaatcttatagcttgcaatgcttttatgaatatctttatgcactcagttgcttcgaccgatgtgggtgtcttgttgttgtgagcagatttggctcgatgtgcacctccctatgtgaggtatgttatcgggatcgggtggcatgccgccacagggtatgttatctggatcgggttgcgcaccgcaacaatgtgatgttgagcatagcttcccatgtatggctttgtattccttgtttcctgacttccgggggaagtctgtattgagaattgcttggtgcttagcgtattagttgtgtccttccagggccgagtggtgtatattacttgtgtcaccgtgtgttaggtgacttgattttaggcattgatatgtgcatggctgtctaccttgggcatggtatcatgagatgtttcatgtgtaacaatattgggttagaatcgcgcgttgtggcgaggccacgtgaagttatgacctctcgaggaggattcagatactttatttctatgagatgagacggggtctccgctttgctttgtgaaggtattgatgagtttgaggtataactcttccggttgtgtcattcgccctgacttgggtatgtgtggactgtttcttttggcgcatgtaatatgtaaattgtgatttaggcttgtatcgaggcatcatatcaccagcagtggtgtgtcagattcgaggtgatcatcgggttattatgaaagtgagcagatgtgatttcagctggttagaaggataatatcgtggtttgacccgaaaatccgttgtggtaataggcaactgggaagtgacttcatgaatggttgatctgaagaactgctacagttcattgcgtgttttagttatcattggcagtatattatagtgttggaataagactttagctgaataagaggtgttctattggtaattgaatgttatgggcagctgctgtgaatagagactatcgttccgagagttggaaggtgtggtatattgcatgaatacacctgaggtttgcaggtgtgggttattatagctggttcggattaattctgagtatagatgtgagtttctgatcttgtgtataatttcaaaagtgctgtgtggttctacggcttatgggtcagatggattgtgaaatttcagttgcggtgtaatttcggcacctatatgagttagggtgacgtaggatcacccgggtatatgtctggtaatgtcatttggttatttgggttgtttctagtacagctctgggtacgctcgaggacgagcgtttgtttaagttggggaggatgtgacgacccgacccgtcgtctcttgtatctctgtcccgttatccccgttatatgttttcccgtgtgttgatatgcgtgttgggagagtttgaaatggtttgggttgaagttggatagaaatgagacaaatagtctcttgaaggaaagcttaagttggaaaagtcaaccggacgttgacttgtgaattagagggctcggaatggatttccgatggcccgactagtttcgggggatgatttgtggcttgtgtgtgaaaacggaagtgaattcggagtcccggtgtgaaagttagcctactttggcgaagttggaatttcggagaaatccggtggataggtgagaatttgatccgggggtcggaatggaattccgacagtggcattagcttcgttaggtgattttggatatgtgtgcaaattttcaggtcaatcggacatcgtttgggtggtttcggcaccggatatgaaattggaaagtttaagtttaattagaatggaatttaaggatttttgatggtttttgatgttaatgatagcgtttttatgatccgagcaagtttgaatgatgtgttagaatgagtttgtgtttttggttgaggtcccgggggcctcggggtgatttcggatgttaaacggattgatttttggttgttgaaggctgctggaattgcagcaggtgttgcagttctatgcgatcgcagaggaccattgcgatcgcatagaaggatttggagggcctggttggttgttctatgcgatcgcaggaggcttatgcgatcgcatagaaggttcaggggaggtggtcagtttgttctatgcgaacgcaggagtgcaatgcgttcgcatagagttgttgctgggcagtcaagatttgttctatgcgatcgcatagaggctttgcgatcgcatagaagggcgtatctgggcagaatgtgttttaagcttagttttgtccgcgaggctcattaagttttccaccatttgtgaagcaccttgagagctaagtgatcaattttgaaggggatttcacgtcattaacttttggaggtaagtctcacgtcattattacgtgtttttatcatagaatcaagcttcaaatatctgaaattgggtgaaattaattaagaactagggcttgggatttcaaatgaagatttgggatttggaggagcaatcggactccgattttgatgaacttgatatgtacggactcgtggcgagacgaggattccgaaaatgtaagtttcgtaatttttcgagaagcgggcccggggctcgggttttgctagtttcgtgattttggctttttctcggtttttttcgattgggtattgtcccatttgcttattgtgatgtattcgctctgcttttggttagattcgatgcgcgaggaggccggattgagaggcaaaggcgtcgcgggcttgagttttcgccggttcgaggtgagtaatgctagtaaatgctgtctgagggtttgaaaccccggactttcacatcgtaacgctatattgaggcgtgactcgcactcctggatatgtgcggagtcggatgttgttggggattgtgacttggtccatcccgagtgagatttatagtatattggcgtatgatacgcacactgtgatgattattattgggctatatgccgtgtttggggcctagtgccgacctgtgatatccttcgggagttgatactactgttcatcgtgattgcatatcatatcatatcagtccatggcttttaaagcattgttttcaaacccagccgtatttcaaatgttcaaactcacataatatcttttaaaatgtatttcggctgaggatcatgacttataactgcccaagtggcttgtgagacatattttctggactgattttggtggctcggactgtacgccacggcaggtattggattgtatgtcatacgcattgtattgcattcatatacacatgcatagttggctcggctgcacgccgtagcggtgattggaccagtggtaatacggacactgtgtcgtatgagcggtcagggtaacatggactgaccgggttattgtttggaccagtggtaacatggacactgtgtcgtatgagcggtcagggtaacatggactgaccgggttattgtttggaccagtggtaacatggacactgtgtcgtattttgccaccacgagatggctgattattgcgtttgggctgtaggagcccctccggagtctgtatacacccccagtgagcgccatcgacgttaaatgatgggtaccggagagtaccggcatttgcattgcatagcattcctgcatttgcatcttacttgttgttcagctttgctcagtttcagatattgttacatatattgttctttagcttgccttgtgtatttctgtgttttcttatcttcggactttatttactgttattactcactgggtcggagtactcacattacttcctgcaccatgtgtgcagatccagggtatgctcaggcggattagatcctgaagcttttcggcatcagcagttcggagcgttgagatagctgcacggcgttcgcagccatcgaccctccttccctctatctttatttccagcattacttttgtattcccagtactaaacagttatgtatcggattgatctatatcctagaggctcagacttgtgacaccggttcctagggagtttttattgatattcagtatttgttccgtctgttttggtacctagatcttgtacattttgagtttatcttctcttttgtatctttcatttgagattatgggtattgtggtcgggcttgcctagccttacggccgggcgccatcgcgaccgggatttgggtcgtgacatgtacagacccggaggggctcctacagcccaagcgcaatatcatcatatcatcgctgcgacgtgcagcccgacccatactcagtccaaactatgcatatgagtcatacaacagattcaatttatagttctcagttccaattattaggaataatataattaagttatttaacgttagggatgtgactaagcatttcgaaacagtgagtaaaacacaggactgagatcaaatgattatgcaaatcatgctatcacaataatatccatcctcgaaggatgctacaggtcggcacaaggccccaaacatggcactaagcccagatatcatcaatacagtgtgtgtatcagtcgccagcatagtataattatcccgcgcgatggaccaagtcacaatctcttatcataaacgatcccacaccttccatggggtgcgagtcacgcctcaatatagcgtcacagtgtgatataccggggtttcaaaccctcaggttatcatctatacagactactcacctctaaccggccgtaaactagtccgcaattccctttcctcttgaatcgacctcctcgcgcgtcgaatcaagtcaaaaccacaacgaatacattactacgtgctaaagacacataacccaattgaaattactcgaaaaacattaaaaatcacaaagttggcaaaacccgagccctgggcccacttctcaaaatccagaaaaccttacaccaaaacgacccttatctcgccacgagtccatacatatcaaatttacaagaatcggagtccatttgacccctcaaatcaccactttaatctctcttaggtttcaagccctaaccaccatttttagcctttaaaatccttaaatttcagtgtttaatcttatgattttacaccatatacacataatccgagtccaatagttcatacctgatgaaaccccttcgaatcctcttcaaaatcgcccaagaatcgcctcacccgaagttcaaatattttctccttctctttaaatctcggaaacaccgttcacttaaaacccaggtcgatttccgcttatgcggtccttgcaccgcacctgcggcttccgtttttgcgatcaaaacaccgcttatgcggtttcacttaagccgccaggggccgcttctgtggtccaaaactgcttttgcggtagccgcatatgcgggcttatgtccgcttctgcggaatcactcaggcctcattggagcctcttatgcggtcccccagccgtatctgcggaaccgcctatgcggtccctttttccgcagatgcagaaatgacagaactagaattccaaaaattatgccaaaccccaaaactatccgtttcaccacccgaacttaccccgaggcccccgggacctcaaccaacagcacagacgtgatctaatacttcattcaaacttgctcgaatcataaaatgctaacgttaacatcaaaatcccttaatttcctcaaatcaaagcctaagtttcttaaaaacttccgaattgcatattcgaccaaaaacccgacctaaacacctccgaatgacctgaaactttacacacatatccaaaatcacttaacggagctactgaaattctcggaattccatttcgaccctcggatcaaattctcgcataccaaccggatttcaccaaaatcctaacttcgccaaaatgggctaacttctacaccgagcctccgaattcagttctgattgctctcctaagtcttaaatcacctcccggaactagttgaatcatcggaaatccattccgagccctctaactcacaagtcaacatccggttgactttcctacacgaacccttccttaaagagactatttgtctcatttcctaccaaactctatccgaaacaattcaaattcaccaaacacctataatgaaacacggggaagcatggaacggggaaaacgagatggaaatacatgagacgacgggtcgggccgtcacatcctccccaactaaaacaaacgctcgtcctcgagcgagtcaagaaacatacctggaacctcaaataggtgaggatatctgctccgcatctcctgctcggtctcccaagtagcctcctccatgggacgacctctccactgtaccttcaccgaaactatatcctttgatctcaatttccgaacctgacgacccaaaatagccaccggctccacatcataagtcaaatcatcatccaactgaaccgagttgtagtccaaaacatgagacgggtccccaacatacttcggaagcatagacatatgaaacaccgggtgaacactcgataagctgggcagcaaagcaagattgtaagccacctctccaatcttcctaagtacctcaaatggtccaataaaccgcggactcaacttccctttctttctgaacctcataacacccttcatgggcgaaaccttcaacaaaaccttctcgccctccataaatgacacatctcggaccttccggtctgcataactcttctaacgcgactgggccgtacgaagcctctcctgaatcaccttcactttctctaaggcatcctgaaccatatctgtccccaacaacctagcctcgccgggctcgaaccaaccaaccggagatctacaccgtctcccatataaagcctcatacggagccatctgaatactggattggtaactgttgttgtaggcaaactctgcaagaggcaagaactcatcccaagaaccaccaaagtctatcacacaggcacgtaacatattttccaatatctgaatagtacgctcggactgtccgtccgtctaaggatgaaatgttgaactcaactctacctgagtacccaactcgtcctgaaaagtcctccaaaactgagaagtgaactgagaacctctattcgatataatagaaactggaacaccatgcaatcggacaatctcacgaataaagatcgctgccagccgctccgaagaatatgtagtatacactggaatgaaatgcgctgacttggtcagccgatccacaatgacccaaatcaaatcgaacttcttctgagtccgagggagaccactcacgaaatccatagtaatcctctcccatttccactcaggaatcaccatccgctgaagtaaaccgcccggtctctgatgttcgaacttcacctgctgacatttagacaccgagctacataactcacaatatcctgtttcattcttctcaaccagtagtgctgcctcaaatcttgatacatcttcgcggcacccggatgaatggaataccgcgagctgtgggcctcctctaatatcatctctcggagcccatccacattgggcacgcaaatacggccctgcatcctcaacacgccatcatcatcaatagacacatccctagcatcgccacgctgaaccctgcccttaaggaaaagcaaatgtgtatcatcatactggatctctctaatgcggtcatataaagaagaccgagaaaccacgctagccaacactcggctaggctccgaaatatctaactgcaccatccgattggccaaagcctgaacatccactgtaaggggtctctccccaactggaatatacgccaaactacgcatactaaccgctttccgcttcaacacatcggccactatattggccttccctgggtgatacaaaatggtaatatcatagtccttgagtaactcaagccacttccgttgtctcagattaagatccttctatttgaatagatgttgaaggctgtggtgatccgtgaacacctcacaagacacgccatataaatagtacctccaaatcttcaaagcatggactatagcagccaactctaagtcatgaacatggtagttcttctcatgaggcttcaactgtcgagaagcataagcaatcactctaccctcctgcataaatacatagccaatcccgatccccgaagcatcacaatatacggtgtaagaacctgaagctgccggcaagactaatactgggttgtggtcaaagctgacttgagcttctgaaagctctccttacactcgtccgaccatacaaatggagcattcttctccgtcaacttggtcaaagacgaagcaatggatgagaaaccctagacgaacctgcgataatagcccgacaagccgaggaaactccgaatctcagtggccgaagatggtctaggccaactctgcacttcctcaatcttctttggatccacctgaataccatcactggacaccacgtgtcccataaatgccacagaaccaagccagaactcacacttggagaacttcgcatagagcttctcctctctcagtctctacaataccaccctcaaatgaatccagatacggccgaaatacattgttcatcaagtgcatgaacacggttggggcattagtcagcccgaaagacataaccagaaactcatagtgcccatatcttattttgaaagtcgtcttcataatatctgaatccctaatcttcagctggtgatagcttgaacgaagatcaatcttggagaacaccttctgtcacgaccctagttcaccaactgtgaacatgtcatgatggcaccaggctggcgaggccaggtaagcctaaagacctagaaactcacgggaaacacaggctaagataatgtatacaaccagctctaaacatccagaatagtctaatacaagggaagtagaatagctgctaactatctgcaggtagagtaagagggagactcgtaggatctgtggacgcggcagatgtgtacctcaagtctcctggtagaagctccctgctaccgctaatagagagccgtgccggaagtacctggatctgcacaacaaaagtgtgcagaagagtagcatgagtacaccacagcggtacttagtaagtgccaagcctaacctcggttgggtagtgacgaggaaggtcgaggccctactgagataaacaagtaaagaatatcgatatataaatgaaacagtcaataaaacatgagagaacagtaataacggagactacgaatagctaacagtcaaagaagacaaaatatacgcagagaacaccaatcgataccaagtactcagtggatctcccaggataccgtcctgtagtccttccatttcacaagcctcagaggatctcccgggataccgtcccgtagtccatttcatccatttaatccgaaggatctcccgagataccgtcccgtagtccatttcatccatttaattcgaaggatctcccgggataccgtcccgtagtccaactttccaaagtgcaaggggagctaccggaatcccacatccgtagtcccaaaataaacaaaaaagggggatctaccggaatcccacatccgtagtcccaaattaaatgcgcaaacacaaccaagaatatacaggaaatgaacatgaaataccaaccgatagagtaaactagcctaacatgatgcacgtatcacaataagagcaaaaataagcatttgagcagttaattatatctaatcatgtttttctatctaacacgggttgagctagcattttatagcagtcgaataagcgagaaaacacagtataagaatttcaagtaaggtggattttcaataattagcacaagtgtatgcccgtcacctcgcacacaaggcgtttaaatcaacaacaaacaattcctaggggaaaaggtcccccacgcaaggttagacaagccacttacctcgaaccggtaccgaatcaatacgatgtgaagcccttgccacgagtatccaactccgaatggcccgaatctaatcaaaccaattacataatgtaaataatatcacaattaactaattacactaataaaattgaagctacaacgtgaaaataggtaaaatgaccaaaatgcccccctggccaacatctcggaatcggataatattcatattttcagaaacctcgcactctcatgagtctaaccatataaaaatctcccaaatcggaggtcaaatgctccctcaaaaacccaattgattagccaaagaactttcacccatttcctccatttttggacctcaatttgaatttaaaagatgaatttagcaactaggtaatgggttaaagctagaaatgatcatagaaacattacccaataatatcctcttcgaaatcctcccaaaatcgccttggtccgagctaaaatttgatttttcaacttatgaacttaagcctcggataaaaccccttttctactgcgatttccgcttcagcggccaattgaccgcgtcggcggtcaccgcttacgcgcttagaccactgcttcagcggtttccttccttaggccagggaccgcttctgcggctgcaggaccgcttcagcggtcgccgcttctgcgagtctaaaaccgctcctgcggtcagccaacgcttccgcgacccactttccgcttcagcggagcccgcttacgcggctctttttccgcgaaagcgaaaacagcagaagacagcagctgcaacactttgaaacttccaaaattatcccgtcggacatccgaaacacacccgaagcccccgagacctcaaccaaacctacgaacatatcccataacatcatttggacttgtaccaatccttaaaccacctaaaacaacgccggaaacacgaattaatcaaggatttaaacttagaattttcaaaacttaactaaaatcgctttcgatcaaaaacctatccaaaacacatccgattgacctgaaattttgcacgcacgtcccaaatgacatgacggtgctacagcaactttcggaattccattccgaccctcggttaaaaaattcactatcggaccggaaactccaaacttccaactttcggcatttctaggctaattgagctacggacatccaaaatacattccggacacgccccccaaccccgaaatcacctaacggagctaacggaaccatcggatttccattccgaggtcgtcttgacactgttccgactacggaccatttccaacacttaagctctcaaatagggactatttgtcccaaaacactccggattcaactaccgaacaacccggcaaaccaaaatagcataaataaacttaggggaagcagttaacgggggaacggggcgcaaattctaaaaacgatcggccgggtcgttacatcctcccacacttaaacattcgttcgtcctcaaacgagcatagagaacatatctgaagtagcaaatagatgagggtaacagctgcgcatatcccgctcggtctcccaagtcgcctcctcgaccggctggccccgccagtgaaccttcactgaggctatctccttagacctgagctttcgaacctgcctgtccaatattgccactagctcctcaatataggacaagtccttgtccaactggactgaagtgaactccaacacatgagacggatcaccgtgatacttccgaagcatcgagacatgaaatagcggatgaaccccggccaaactaggaggtaaggcaagctcataagaaacctccccaacccgcctcaaaatctcaaaaagggccgataaacctcggactcaactttcccttctttccgaacctcatgacgcctttcataggcggggcccggagcagaacccgctcaccaaccataaaggaaacatcgcgagccttccggtccgcgtaactcttttgtctggactgggctgtacggagtcgatcctgaatcattttaaccttttctaccacatcctgaaacaaatctgtacccaatagtctcgcctcacccggctcgaaccaacccaccggagacctgcatctcctaccatataaagcctcatacggcgccatctgaatgctagactgataactattattgtaagcaaactccgccaatggaaagaactgatcccaagaccctctaaagtcaatcacgcacgcacggagcatatcctcaagaatctgaatagtgcgttcggactgtccgtccgtctaagggtgaaatgttgtgctcatagtcacctgagtacccaactcatgctgaacggccctccagaaccgtgatgtaaactgagaacccctgtctgagatgatagaaaatagaatgtcgtgcagacggacaatctccctgatataaatacccgctaaccgctccgcagagtatgtagtacacactggaatgaaatgagcggacttggtcagctgatctacaatgacccaaatagaatcaaacttctttacagtcaacggaagaccaactacgaaatccatggtgattttctcccatttccactctgggatctcaatctgctgaagtaatcctcccggtctctgatgctcagcctttacctgctggcagttaaggcatctagctacaaattccactatgtctttcttcatccgcctccaccagtaatgttgtctcaaatcctgatacatcttcgctgcacccggatggatgaaataccgcgagctatgagcctctgccaatatcaactcccgaatatcatcaatgtcgggtacacagatcctaccctgcatcctcaataccccgtcctctccgatagacacatctttggcatcgccaagctcaactctacccctgagatcaagtaattgagggtcatcatattgtcgctccctgatacgatcaaacaatgaagaccgagagaccacacaagctagaacccgactgggctctgaaagatccaatctcacgaactgactggctaaggcctgaatatccatcgccataggcctctcaactgctggtagatatgccaaactacccaaactctccgcccggcgactcaaggcttcagccaccacattggccttgcccgggtgatacagaatagtgatgtcataatctttcaacaactccgtccatcttctctggcgcaaatttagatccttctgcttgaacaagtgctgcaagctccgatgatccgtataaatctcacaaggcacgccatacaaatagtggcgccagatcttcaaggcatgaacaatagcacctaactcgagatcatgtacaagataattcttctcatgtaccttcaactgtctggacgcgtaggcaatcgccctaccattctgcatcaataccgctccaaggccattcctcgaggcatcacaatatatagtataagagcccgaacttgtaggcaggataagaactggggctatagtcaaagctgtcttgagctactgaaagctcgcctcgcactcttccgtccattggaacggagcacccttctgggtcagtctagtcataggtgctgcgatagaagaaaacccctcaacaaatcgacggtaataatcgccaagccatgaaaactgcgaatctcaatcacggaggaaggtctaggccaactctgtactgcctctaccttcttcagatcaacccgaataccctcgctcgacaccacgtgacctaagaaggccacagaatacaaccagaactcacattttgagaactttgcatacaacttcttttctctcaaagcctgaagcactgtcctcaggtgctgctcgtgctcttcctgactccgggagtaaacaagaatatcatctatgaaaacaataacaaacaagtcgaggtatggccggaacacactgcgcatcaagtgcatgaaggcagatggggcattggtcagcccaaaagacataactagaaactcgtagtggccataccgagtcctgaaggcagtcttcgggatatccggctcctgaatctttaactgatggcatcctaagcgcaaatcaatcttagaaaacactcgtgcgccctgaagctggtcaaagagatcatcaatacgaggcaaaggatagcggttcttcattgtaaccttattcaactgacgataatcaatgcacatgcgcatagaaccattctttttctttacaaacaagacaggagcaccccacggataaacactgggcgaatgaatcccttatcaagcaactcctataactgctccttcaactccttcaactcaggaggagccatacggtaaggaggaattgatatgggctgagtgcccgacaaaaaatcaataccaaaatcgatgtcccgatcgggcggcatgcccggaagatcagctgggaaaacatcgggatagtcccgtactacgggaacagaatcaatagaaggggtatcaacactaacatctcacacataagccaagtacgcggcacaccccttctcaaccatacgttgagccttaagataagagataactctgctgggagtgtgatcaaaagtatcactccacacaatacgagaaataactggcatagccagcgtcacagtcttagcgtgacaatcaagaatagcaaaatggggcgacaactagtccatgcccaagataatatcaaaatccaccatatgcagtaataaaagatcagctctggtctcaaaaccacggatagtaaccaaacacgatcgataaacgtggtccacaacaagagaatctcccacaggagtagaaacataaataggagaactcaaagaatcccgggctacgcccaaatatagagcaaaataagaagacacataagaataagtagagcctggatcgaatagaaccgatgcatctcggtgacaagctagtataatacatgtgatgacagagtcagaggcaacaacctcagtacgaacaggcatggcatagtatcgggcctggcctcccctttgagggcaacctctaactcccctacccccgcccctggctggctgggcaggtggggtggcagctggagctggaacaatagcctaggaaccctgtggagcacgctgaggctgtggagcctgggatgatgcacccctcccaagtctgggacaatccctaaccatgtgacgtgagtcagcagactcatagcaagctctgggaaggcgcggtggctgtgactggctgggtcctcccctgctggaccgtcctctgtgagcaccccgcacaggaggcgcgctagaaactggaggtgcatagtaaggctcctgagatctgggaggagctgaagtgccgctggatgaaggaagtgctgagtgaactgggcgacccatatagcccctaccgtgatgacatgctgctggggtacgggtaccagagtagcgacccgactcccgagacctcttggcctccttctcatcacgcttcccgatgtgcaaaccctcaatccttcgagcaatgttcactacctactgataagaaatgtctatctcaagctctcgggccatgctagatctgataggagaaataagaccctcaatgaacctgcggaccctcttacgaaccgtggcaaccaaagaaggtgcatgtctagccaacctggtataacggatggcatactcagaaactatcatagtaccctggcgtagatgctcaaactccgctcgccaagcatccccgagactctggggaacaaactccctctcaaacatagcagaaaattgtgcccaagtcagggaggcagcctgatccggactggatagctcataagtacgccaccaattataggcagctccccgaagctggaaagctgcaaaggaaaccccgctcgtagcagtaatacccatggtgcggaaaatgtggtgacaatcctctaaatactccaaggcatcctacgtggccaatccgctgaataccggagggtcatacttcttaaacctttctaaccttctctgctcatcctctgaggcaagtatatcatcctccggatggaccggtgcggcaggctggacatgaacgacaccaggagcctgctcaacatgcactcgctgctctagagtgcgggcggcgggagtctgtgcttctcccccggcctaggaagtggttgcaggaaggggaagcaaccctgcctgagacaatgcagtataggcactcataaactgggccagtgcctcctgaatagatggagtagtagtggctgtgggcgtgtcgggcgtctgagccccgactgaaacggctggcagtacctctgcggcagctcgcggaggtgctctggctgcaccacgtgtgcgtccacgacctcgtccctggcccctgcctctaacggctgcaggagggtgtatgggtgcctgatcatctcgggtcgtgcgtgtcctcaccatctatgagagaatagaaagatagaagttagatttggtgtccaacatatcgcacgacaaggaaatcaaatgaagtgaagatttttcctgaacagttacatagcccctcgtagataagtacagacgtctccgtacctatcagcgagactctaataaaccggcctgtgtcccgtgactcctatgaacctagagctcggataccaacttgtcatgaccctagttcaccaactgtgaacatgtcatgatggcacctggccggcgaggccaggtaagcctaattcaatgcggaatgtaacatttaaataagaaaggataaataaaatgaatgaacttaagaaaatgttataagtgccgcatggcacatacacttagaataataaaccatctgaaatactatcccaaagacccggaaactcacgggcaacacaggctaagataatgtatacaaccagctctaaacatccggaatagtctaatacaagagaagtagaatagctgctaactaactgcaggtagagtaagagggaggctcgtaggatctgcggacgcggcagatgtatacctcaagtctcctggtagaagctctctgctactgctgatattgagccgtgccggaagtacctggatctgcacaacaaaagtgtgcagaagtgtagcatgagtacaccacagtggtacttagtaagtgccaagcctaacctcggttgggtagtgacgaggaaggtcgaggccctactgagataaacaagtaaagaatatcgatatataaatgaaacagtcaataaaacaggagagaacagtaataacggagactacgaatagctaacagtcaaagaagacaaaatatacgcagagaacaccaatcgataccaagtactcagtggatctcccaggataccgtcctgtagtctttccatttcacaagcctcagaggatctccggggataccgtcccgtagtccatttcacccatttaatccgaaggatctcccgagataccgtcccatagtccatttcatccatttaatccgaaggatctccggaataccgtcccgtagtccagctttccaaagtgtaaggggagctaccggaatcccacatccgtagtcccaaaataaacaacaaagggggatctaccggaatcccacatccgtagtcccaaattaaatgcgcaaacacaaccaagaatatataggaaatgaacatgaattaccaaccgataaagtaaactagcctaacatgctgcacgtatcacaataagagcaaaaataagcatttgagcagttaattatatctaatcatgcttttctatctaacacgggttgagctagcattttatagcagtcgaataagcgagaaaacacagtataagaatttcaagtaaggtggattttcaacaattagaataagtgtacgcccgtcacctcgcacacaaggcgtttaaatcaacaacaaacaattcctaggggaaaaggtcccccacgcaaggttagacaagccacttacctcgaaccggtaccgaatcaatacgatgtgaagcccttgccacgagtatccaactccgaatggaccgaatctaatcaaaccaattacataatgtaaataacatcgcaattaactaattacactaataaaatttaagctacgacgtgaaaataggtaaaatgaccaaaacgcccctctggccaacatctcggaatcggataattttcatattttcagaaacctcgcactctcacgagtctaaccatataaaaatcccctaaatcggaggtcaaatgctccctcaaaaccccaattgattagccaaagaactttcacccatttcctccatttttggacctcaatttgaatttaaaagatgaatttagcaactaggtaatgggttaaagctagaaatgatcatagaaacattacccaataatctcctcttcgaaatcctcccaaaatcgccttggtccgagctaaaatttgatttttcaacttatgaacttaagccttggataaaaccccttttctactgcgatttccgcttcagcggccaattgaccgcgtacgcggtcaccgcttatgcgcttagaccactgcttcagcggtttccttccttaggtcaaggaccgcttctgcggctgctggaccacttcagcggtcgccgcttctgcgagtccaaaaccgctcctgcggtcagccaccgcttccgcgacccactttccgcttcaggggagcccgcttacgcggctccttttccgcgaaagcgaaaacagcagaagacggcagctgcaacacttcgaacttccaaaattatcccgtcggacatccgaaacacacccgaggcccccgggacctcaaccaaacctacgaacatatcccataatatcatttggacttgtaccaatccttaaaccacctaaaacacgccggaaacacgaattaatcaaggatttaaacttagaattttcaaaacataaccaaaatcgctttcgatcaaaagcctatccaaaacacgtccgattgacctgaaattttgcacgcacgtctcaaatgacatgacggtgctacagcaactttcggaattccgttccgaccctcggatcaaaaattcactatcggaccggaaactccaaatttccaactttcggcatttctaggctaattgagctacggacatccaaaatacattccggatacgcccccaaccccaaaatcacctaacggaactaacggaaccatgggatttccattccgaggtcgtcttgacactgttccgactacggaccattttccaacacttaagctctcaaatagggactatttgtcccaaaacactccggattcaactaccaaacatcccggcaaaccaaaatagcataaataaacttaggggaagcagttaacgggggaacggggcgcaaattctaaaaacgaccggccgggtcgttacatcctcccacacttaaacattcgttcgtcctcgaacgagcatagagaacatatctgaagtagcaaatagatgagggtaacagctgcgcatatattccgctcggtctcccaagtcgcctgctcgaccggctggccccaccactgaaccttcactgaggctatctcttagacctgagctttcgaacctgcctgtccaatattgccactggctcctcaacataggacaagtccttgtccaactggactgaagtgaactccaacacatgagacggatcaccgtgatacttccgaagcatcgagacatgaaataccggatgaaccccggccaaactgggaggtaaggcaagctcataagcaacctccccaacccgcctcaaaatctcaaaagggccgataaacctaggactctactttcccttctttccgaacctcatgacgcctttcataggcggggcccggagcagaacccgctcaccaaccatgaaggaaacatcgtgaaccttccggtccgcgtaactctttgtctggacgggctgtacggagtcgatcctgaatcattttaaccttttctaccgcatcctgaaccaaatctgtacccaatagtctcgcctcacccggctcgaaccaacccaccggagacctgcatctcctaccatataaagcctcatacggcgccgtctgaatgctagactgataactattattgtaagcaaactccgccaatggaatgaactgatcccaagacccaataaagtcaatcacgcacgcacggagcatatcctcaagaatctgaatagtgcgctcggactgtgaatccgtctgagggagaaatgctgtgctcatagtcacctgagtacccaactcctgctgaacggccctccagaaccgtgatttaaactgagaacccctgtctgagatgatagaaactggaatgtcgtgcagacggacaatctccctaaaaaaatacccgctaaccgctccgcagagtatgtagtacacactggaatgaaatgagcggacttggtcagctgatctacaatgacccaaatagaatcaaacttctttgcagtcaacggaagaccaactacgaaatccatggtgattttctcccatttccactctgggatctcaatctgctgaagtaatcctcccggtctctgatgctaagcctttacctgctggcagttgaagcatctagctacaaattccactatgtctttcttcatccgcctccacagtaatgttgtctcaaatcctgatacatcttcgctgcacccggatggatggaataccgcgagctgtgagcctctgccaatatcaactcccgaatatcattaatgtcgggtacacagatcctaccctacatcctcaataccccgtcctctccgatagacacatctctggcatcccaagctcaactctacccctgagatcaagtaaatgatggtcatcatattgtcgctccctgatacgatcaaacaatgaagaccgagagaccacacaagctagaacccgactgggctccgaaagatccaatctcacgaactgactggctaaggcctgaatatccatcgccataggcctctcagctgctggtagatatgccaaactacccaaactctccgcccggcgactcaaggtgtcgtccaccacattggccttgcccgggtgatacagaatagtggtgtcataatctttcaacaactccatccatcttctctggtgcaaatttagatccttttgcttgaacaagtgctgccagttccgatgatccgtataaatctcacaaggcacgccatacaaatagtggcgccagatcttcaaggcatgaacaataacagctaactcgagatcatgtacaagataattcttctcatgtaccttcaactgtctggacgcgtaggcaatcgccctaccgtcctgcatcaataccgctccaaggccaatcctcgaggcatcacaatagacagtataagagctcgaacctgtaggcaggataagaactggggctgtagtcaaagctgtcttgagctactgaaagctcgcctcgcactcttccgtccattggaacggagcacccttctgggtcagtctagtcataggtgctgcgatagaagaaaacccctcaacaaatcgacggtaataaccgccaagccaagaaaactgcgaatctcaatcgcggaggaaggtctaggccaactctgtactgcctctaccttcttcggatcaacccgaataccctcgctcgacaccacgtgacccaagaaggccacagaatccaaccagaactcacattttgagaactttgcatacaacttcttttctctcaaagcctgaagcactgtcctcaagtgctgctcgtgctcctcccgactccgtgagtaaacaagaatatcatctatgaaaacaataacaaacaagtcgaggtatggccggaacacactgcgcatcaagtgcatgaaggctgttggggcattggtcagcccaaaagacataactagaaacccgtagtggccataccgagtcctgaaggcagtcttcgggatatccggctcccaaaaatttaactgatggcatcctgagcgcaaatcaatcttagaaaacactcgtgcgccctgaagctggtcaaagagatcatcaatacgaggcaaaggatagcggttcttcactgtaaccttattcaactgacgataatcaatgcacatgcgcatagaaccattctttttctttacaaacatgacaggagcaccccacggagaaacactgggcgaatgaatcccttatcaagcaactcctgtaactgctccttcaactcaggaggagccatagggtaaggaggaatagatatgggctgagtgcccggcaaaaaatcaataccaaaatcgatgtcccgatcgggcggcatgcccgaaagatcagctgggaaaacatcgggatagtcccgtactacggggacagaatcaatagaaggggtatcaaaactaacatctcgcacataagccaagtacgcggcacaccccttctcaaccatacgttgagccttaaaataagagataactctactgggagtgtgatcaaaagtaccactccacacaatacgaagaataactggcatagccagcgtcacagtcttagcgtgacaatcaagaatagcaaaatgggtcgacaactagtccatgcccaagataatatcaaaattcaccatatgcagtaataaaagatcagctctggcctcaaaaccacggatagtaaccaaacacgaccgataaatgcggtccacaacaagagaatctcccacaggagtagaaacataaacaggagaacttaaagaatctcgggctacgcccaaatatagagcaaaataagaagacacataagaataagtagagcctggatcgaatagaaccgatgcatctcggtgacaaactagtataatacctgtgatgatagagtcggaggcaacagcctcagtacgagcaggcatggcatagtatcgggcctggcctccccctcgagggcaacctctaactcccctacccccgcccctggctggctgggcaggtggggtggcagctggagctggaacaatagcctgggaaccctgtggagcacgctgaggctgtggagcctgggatgatgcacccctcccaagtctgggacaatccctaaccatgtgacgtgagtcagcacactcatagcaagccctgggaaggcgcggtggctgtgactggctgggtcctcccctgctggaccgtcctctgtgagcaccccgtgcaggaggcacgctagtaaccggaggtgcatagtaaggctcctgagatctgggaggagctgaagtgccgctggatgaaggaagtgctgagtgaactgggcgacccatatagcccctaccgtgatgacatgctgttggggtacgggtaccagagtagcgacccgactctcgagacctcttggcctccctctcatcacgctccccggcatgcaaacccttaatcctccgagcaatgttcactacctgctgataagaaatgtccatctcaagctctcgggccatgctagatctgataggagaaataagaccctcaatgaacctgcggaccctctcacgaaccgtggcaaccaaagcaggtgcatgtctagccaacctggtataacggatggcacactcagaaactgtcatagtaccctggcatagatgctcaaactccgctcgccaagcatccctgagactctggggaacaaactccctctcaaacatagcagaaaattgtgcccaagtcggggaggcagcctgatccggactggatagctcataagtacgccaccaatcataggcagctccccgaagctggaaagctgcaaaggaaaccccgctcgtagcagtaatacccatggagcggaaaatgcggtgacaatcctcgaaatactccaaggcatcctccgtggccaatccgctgaataccggagggtcatatttcttaaaccttctaacctcctctgctcgtcctctgaggcaggtatctcatccttcggatggaccggtgcggcaggctggacatgaacgacaccaggagcctgctcaacatgcactcgctgctctggagtgcgggcagcgagagtctgtgcttctcccccggcctgggaagtggctgcaggaaggggaagcaaccctgcctgagacaatgcagtataggcactcataaactgggccagtgcctcctgaatagatggagtagtagtggctgtgggcgtgtcgggcgtctaagtcccgactggaacggctggcggtacctctgcggcagctcacgcaggtgctctggctgcaccatgtgcgcatccacgacctcggccccggcccctgcctctaacggctgtaggagggtgtgcgggtgcctgatcatctcgagtcgtgcgtgtcctcaccatctatgagagaatagaaagacagaagctagatttggtgtccaaaatatcgcacgacaaggaaatcaaatgaagtgaagatttttcctaaacagctacatagcccctcgtagataagtacggacgtctccgtaccgatcagcaagactctaataaaccggcatgtgtcccgtgactcctatgaacctagagctctgataccaacttgtcacgaccctagttcaccaactgtgaacatgtcatgatggcacctggccggcgaggccaggtaagcctaattcaatgcgaatgtaaaatttaaataagaaaggataaataaaatgaatgaacttaagaaaatgtgataagtgccgcatggcacatacacttagcataataaaccatctgaaatactatcccaaagacccggaaactcacgggcaacacaggctaagataatgtatacaaccagctctaaacatccggaatagtctaatacaagggaagtagaatagctgctaactaactgcaggtagagtaagagggagactcgtaggatctgcggacgcggcagatgtatacctcaagtcttctggtagaagctccctgctactgttgatagtgagccgtgccggaagtacctggatctgcacaacaaaagtgtgcagaagagtagcatgagtacaccacagcggtacttagtaagtgccaagcctaacctcggttgggtagtgacgaggaaggtcgaggtcctactgagataaacaagtaaagaatatcgatatataaatgaaacagtcaataaaacaggagagaacagtaataacggagactacgaatagctaacagtcaaagaagacaaaatatacgcagagaacaccaatcgataccatgtactcagtggatctcccaggataccgtcctatagtccttccatttcacaagcctcagaggatctcccgggataccgtcccgtagtccatttcatccatttaatccgaaggatctcccgagataccgtcccatagtccatttcatccatttaatctgaaagatctcccgggataccgtcccgtagtccaactttccaaagtgcaaggggagctaccggaatcccacatccgtagtcccaaaataaacaacaaagggggatctaccggaatcccacatccgtagtcccaaattaaatgcgcaaacacaaccaagaatatacaggaaatgaacatgaaataccaaccgatagagtaaactagcctaacatgatgcacgtatcacaataagagcaaaaataagcatttgagcagttaattatatctaatcatgcttttctatctaacacgggttgtgctagcattttatagcagtcgaataagcgagaaaacacagtataagaatttcaagtaaggtggattttcaacaattagcacaagtgtacgcccgtcacctcgcacacaaggcgtttaaatcaacaacaaacaattcctagggaaaaaggtcccccacgcaaggttagacaagccgcttacctcgaaccggtaccgaatcaatacgatgcgaagcccttgccacgagtatccaactccgaatggccctaatctaatcaaaccaattacataatataaataacatcgcaattaactaattacactaataaaattgaagctacgacgtgaaaataggtaaaatgaccaaaacgcccctcaggccaaaatctcggaatcggataattttcacattttcagaaacctctcactctcacgagtctaaccatataaaaatctcccaaattggaggtcaaatgctccctcaaaaacccaattgattagctaaagaactttcacccatttcctccatttttggacctcaatttgaatttaaaagatgaatttagcaacttggtaatgggttaaagctagaaatgatcatagaaacattacccaataatctcctcttcgaaatcctcccaaaatcgccttggtccgagctaaaatttgatttttcaacttatgaacttaagcctcggataaaaccccttttctactgtgatttccgttttagcggccaattgaccgcgtccgcggtcaccacttacgcggttagactaccgcttcagcggtttccttccttaggccagggaccgcttctgcggctgcaggaccgcttcagcggtcgccgcttctgcgagtccaaaactgctcctgcggtcagccaccacttctgcgcccactttccgcttcagcggaacccgcttacgcggctcctttttcgcgaaagcgaaaacagcagaagacagcagctgcaacactttgaaacttccaaaattatcccgtcggacatccgaaacacactcgaggcccccgggacctcaaccaaacctacgaacatatcccataacatcatttggacttgtaccaatccttaaagcacctaaaacaatgccggaaacacgaattaattaaggatttaaacttagaatttttaaaacttaaccaaaatcgctttcgatcaaaaacctatccaaaacacgtccgattgacctgaaattgtgcacgcacgtcccaaatgacatgacggtgctacagcaactttcagaattctgttccgaccctcggatcaaaaattcactatcggaccggaaactccaaatttccaactttcggcatttctaggctaattgagctacggacatccaaaatacattccggacacgcccccaaccccgaaatcacctaacggagctaacggaaccataggatttccattccgaggtcgtcttgacactgttccgactatggatcattttccaacacttaagctctcaaatagggactatttgtccgaaaacactccggattcaactaccgaacatcccggcaaaccaaaatagcataaataaacttaggggaagcagttaatgggggaacagggcgtaaattctaaaaacgaccggccgggtcgttacaccttcgccctttgaagctggtcaaataaatcctcaatacggggtagtggatacttgttcttcacggtcaacttgttcaactgtctgtagtcaatgcacattctcattgtgccatctttcttcttcacaaataacacaggtgcaccccacggggacacactaggccgaataaaccccttttctaggagttcttgaagctgatccttcaattcctttaactttgcaggtgccatgcgataaggcaggatagaaatgggctgagtgcccggcaccagatcaataccgaaatcaatgtccctgtccggcggcatgcccgacaggtctgctggaaacacattagggaaatccctcacaacgggaaccgaatcaagactaggagcctcagctccgacatatctaacaaaagccaagtacgatatacaacccttcccaaccatccgctgggccttaaggtaagaaatcaccctgctgggtacataaccagtcacccctcgccactcaaccctcggaatacccggaatggccaacgtaactgccttggcatgacagtccagaatagcatggtatggggatagccaatccatacccagaatcacatcaaagtctaccatgcccaacaataataagtcaactcgggtctccaaacccctaatagtaaccatataggatcgatatacatgatccacaataatagtatcacccaccggggtagatacgtgcacaggcaaagcaagataatcacgggtcgtacccagatgatggcaaaataggaagacacataagaatacgtagatccgggatcaaataagacagaagcatccctgtgacagactggaataatacatgtgatacctacgtctgatgcaatagcatctgccctgtccgggataacatagaattgggcctgaccaccgccagtctggcctccacccctggggcggcctctggctacctggcctccaccccttgctggctgagtaggtgctgatgaaataggagcagaagatgagggttggtccctctgctgagatcgaccaccacgtagccgaggacactgtctcctcatgtggccaaactcaccacactcaaagcaactccccagtgctggagaaggggactgaagggaacccctcgctgcagatgaaccctgggctgatgaagcaggagtagagctctgagctggaagggcactcggtgaactctagccctgctgatatccttgataaccccggcttgaagaggccccactagactctgtacgtcctgactgaggaggcctgaaggaacgacctctaccacgctggaactggcccctagacggagcaccactgaagccacctgaacctcgaggcctcttggcctccctctccacacgctcccgacagcgatctgtctcaatctgtcgagccgcatcaactgcctcctcaaacgaagctgccgcaaccctctctctagttatcaatatgcgaatcggatagttgaggccatccacgaacctcctgatcctctcccgatatgtcgggatcatccaagtagcatcccgagctagctgtgtaaacctcaactcgtactgggtcacagtcatgtccccctgagtcaaccactcaaactgacgacgcagctcctccctgtgagactgcggtacatacttctccaaaaataaagtggagaactgctgccaagtgaggggtgctgctccaataggcctacacctctcaaactcctcccaccaagtaaatgcaggccctgtgaactggaaagtagtaaaagtcactccactagactccagaatccctgcggtgcgaagcatacgctggcacttgtctagaaatccctgggcatcctcgccctcagtaccactgaatgtcggaggctggagtctaccgaacctctccaatcgatgctgctcgtcgtcgggcataactggaacaataaagtctggagctgctgcgactggcgcaactggggcaactggtgcaactggtgcaactggtgcaactggtgcaactggagcaactggagcaactagggctgcctctggtgtctgcaatccctgaacaacctactcgggtgtgcgagctgcgggggtctgatgaccacccccggtttgagaagtagccgccactgtagtggctgaaaccgcctgagccaggccggtacagacggacaagatctgagccaaagcctcctggaggccaggaatcacaatgggcactatcggtgcctgaacaggtgctgctggagcatctacaaaaggaggctggacctgaaccttagcagctggtgggtcggcaggtggtgcccccactggtctacctcgaccatgaccacgaccgcaccacggcctctagcaggtggcactggtggtcgtccgctagttccgttagcacgggttctcgccatctgcgagagaatagaatatagaaagtgaagtatttcctaaaggttctgtaacctctcgaggatagatacggacgtctacgtactgatccgcaagactctactaaaccggctcatgactcgcgaggcctagtaacctaggctctgataccaacttgtcacgacccaaaccaggtcgtgatggcgcccaacaataaagctaggcaagcctgaccaataatcactcaaaagcccaacaatacatctcattaccgacaatttaagggaatttaacagtttagaataataatccgatatttatagtaataataatacggaaaaaaccgaaatatctgacaaaacactcccaataggatctggggtcacgagtctagagcctctaaaacaagctgaataacaatatccgaaagaaaatacataagtctggaatgcagaaataaaactgaaataagaggagtggtcgggtcctgcgaacgtcaagcagctaccttaataactctaatataactctgggagacagcgactgctcagctaagcctctggaacacctgaatctgcatacaaggtatagggagtagggtgagtactaccaactcagtgagtaataagtatatataatatctgaagataagaatccacgaaatgccacaatggaaagctaaagctaaaagtctgacacaattaacgatgaaccaatatcagaacaacatcaggtatatcagataagtataaattcatgaatgcaatgcaatgcacatgaccgttgcggcgtgcaacccgctccatttgggtacccgtgctcactaggggtgtgtacagactccggaggggctcctacagcccaagcgcaatatcatcatatcatcgctgcggcgtgtagctcgactcatactcagtccagactatgcatatgagtcacacaacagattcaatttatagttctcagttccaattattaggaataatataactaagttatttaacgttagggatgtgactaaggatttcgaaacagtgagtaaaacacaggactgagatcaaatgattatgcaaatcatgttatcacaataatatccatcctcgaaggatgctacaggtcggcacaaggccacaaacatggcactaagcccagatatcatcaatacagtgtgcgtatcagtcgccagcatagtataattatcacgcgggatggaccaagtcacaatccccaataataaacgatttcacacctgccatagggtgcgagtcacgcttcaatatagcgtcacagtgtgatataccggggtttcaaaccctcaggtcatcatctatacaggctactcacctctaaccagccgtaaactagtccgcaatgcccttttctcttgaatcgacctcctcgcgcgttgaatctagtcaaaaccacaacgaatacattactacgtgctaaagaaacataacccaattgaaattacttgaaaaacattaaaaatcacaaagttggcaaaactcgatccccgggcccacttctcaaaatccaaaaaaccttacaccaaaacgacccttatctcgccacgagtcaatacatatcaaatttacaagaatcggagtccatttgacccctcaaatcaccactttaatctctcttaggtttcaagccctaaccaccatttttagcctttaaaatccttaaatttcagtgtttaatctatgattttacaccatatacacataatccgagtccaatagttcatacctgatgaaaccccttcgaatcctcttcaaaatcgcccaagaatcgcctcacccgaagttcaaatattttctccttctctttaaatttcggaaacactgttcacttaaaacccgggtcgatttccgcttatgcggtccttgaaccgcacctgcggcttccgcttttgcggtcaaaacaccgcttatgcggtttcacttaagccgtcaggggccacttctacggtcccaaaccgcttctgcggtagccgcatatgcgaacttatgtttgcttctgtggaatcactcaggccccactagagccgcttatgcagtcccccagccgcatctgcggaaccgcctatgcggtcccttttccactgatgcggaaatgacagaaccagaattccaaaaattatgccaaactccaaaactctctgtttcaccacccgaactcaccccgaggcccccgggacctcaactaacagcacagacgtgatctaatacttcattcaaacttgctcgaatcataaaaacactaacgttaacatcaaaatcccttaatttcctcaaatcaaagcctaagtttcttaaaaacttccgaattgcacatttgaccaaacacccgacctaaacacctctgaatgacctgaaactttacacacatatccaaaatcacttaacggagcaactgaaattctcggaattccattccgaccctcggattaaattctcgcataccaaccggatttcaccaaaattctaacttcgccaaaatgggctaacttctacaccgagccttcgaattcacttccaattgctctcctaagtcttaaattacctctcggaactagtcgaatcatcagaaatccattctgagccctctaactcacaagtcaacatccggttgacttttctgcactaacccttccttaaaaagactatttgtctcatttcctaccaaactctatctgaaacacttcaagtttaccaaacacctataatgaaacacggggaagcatagaacggggaaaacgagatggaaatacatgagacgacgggtcaggtcgtcacaacaccgacgtatagatactcgtcaccatgcctatatgtcgtactcataattagcacataacaagtaagactcaacttctaatcgctcaagttaaggttagaccaaacacttacctcgatgccttgaacaccactcaaatctcaattattgatttacctcttgattccaccaccaatccgctcgaatctagtcataagttacttaatcacattaataaattctaaatgaatcaaccccaatggatgaaaataaattttacaaggtgttacccaaaaaggtgaaaaatgcccccgggcccacatggccaaaactcgaggttcgaaccaaaacccggttacccattcccccacgaatccaaatatatgatttgttttgaaatcagacctctaattgaggtccaactctccaaattttagaaaacctaggttctaccccaaatacccaatttccccataaaaatctttgatttgcagttgaaatcatattaaaagatgttacgaagtgaagaaaataagttagaaataacttaccaatcattttggagaagaaacgttgtttggaaaatcgcctcttatgttttggggttttggaaagtgaaaaataactaaaattcccgtttatatatacccctctaaagctctctgtgcggaccgcgcaaaaaggatggcgggcgcacaggcctcctgtagacctgcagatcattgccccgtgcggaccgcacaaagccaaccgcggccgcacaacatccaccgcagacctctcaaaggctaccacggccgcgctggcccctccgcggccgcacgttatatgtcgcggaccgcacaaaagggttcagagacctgcaatattttctgaacctgcaacatctgatcttttaagcctaaggcatcccggaacccactcgaaactcatccgcaccctcgaagctctaacccaagtatgaacactacctcaaaaacctcctacaaacatattcgtgtgatcaaatcaccaatataacataagcgaattaaacctcaagatcagtgaaatttctcaaaacaccttttaaacatcaatttcccgattcgggtctggatcacgtcaaacgacatctgtttttaaccaaactttacatgagttatcaaaacatatataagacttgtaacgggcgctagaacaaaaatacggtcccgataccatcgctttctaatcagatttcatttcaattttctttaaaccttttcaaaaaataatttcacttaaaaatttatatctcgggcttgggacctcgaaattcgattctgagcatacgtccaagtcccatattttcctacggacccttcgggaccgtcgaatcatgggtccgggtccgtttatctatatgttgaccgaagtcaaatttgttcatttcaaagtcaacacttaacaattttcacaaaattttacatttaagctttccagctacgcgcccggattgtgcacacaaatcgaggtgactttaaaggaggtttttaaagcctcggagacacagaatacaagtaaaacaggtgatgaccctttgggtcgtcacaaaagtgaagttgtcctcctaagtaatcaattttatgatagaatgtactgaagaaccaccgagtcttccctatgtgatagttatcactcgcctcctcaaatccttcaatatccctctctcaaactacccctatgtgtcggtctccaagtgttacaataatagagcgtttgtcagcctgggttatgttgttgtggatggtggttggataaaaaaggatgaaactaaagaaaaagtgattctctatagcttcaaggtaaaatttgatacttcaaatgcttctatgaacaatccataattacttgcaaagattgttgcacttgacgacaagttgactgccatcgaagatctgctcctggtcacgcagtcttcagttagtgatgtctacaaagtttccaaagaaataggttctgatgtgtccaagctaagagtcatggtttagacgactatagaaaacacagtaaaatcctttaaggaagtgcatgatcgtgttgatggaatctcggtcacaatgaacgtaagctttgaccatcttaaagaagccatctgcaatacttttacctattttctacgtcgttgatcaatgttagttgtgttaagacaatgtttttgctccattgtggatatttttggatgcttgcatggtttgcctatcttgaatgtttttggataatctggatgactgtaattattaaaccgattgtctgctagtaatactacttgcttagccctctttttgtgtgatcccaaagggggagaaatgatcaactaatttgctggtaattcgagtcaactagctgggaaggatcgacaagtcgactagctagaaagaaagtcgactaaccaactcatgaaagacaacaagttgatggggagccgaatcaaaagacctgacagcaagttgagggggagacgactgaagatgaaataaataggggatgattgttagatctattttttaatgatggaaaataacttaataatattgcaggaaagtaactccaaagaaggaagtcaagaaagcaaattggaagtctacaaatgaagaagagatcgagatcctgaaggatggattaaggaatgagatcctactgaagattcagaagcaaggattaaggaatcggtcttgcacatgattacgagcattaaggagaacaaatatttgactgcggttatttatggaaggaataacaatcaatttgcgtgaatgatttgcgaagaataatcaatcacaatctttaaggaagtaacagccatcacgccactctttaaggacaaagtatagaaagttccttccgtattcttggaaggaatcaattcaagattgattttgaggatcaactcccttaggtttccatcatctaaggatttgtcataacaataagactcaccttcaaattacatgaatacaacaagaggctcaacagaaggatatattttgatcgaacaattaccaatctgtttgttctagatttactgtgtaactagggagaaaagaagaagagaaaagaatcattggtgaggcattatatcaaaagcaagaaaataacatatatcatgaagaagttgttggtgtataacaacatcaacatacctgtaccaaagatttcaaatactcaaaagagaactcacttgcaacctaatgggactggagtaggattcacattgaattcaaaccactataaaaaatctggtataatttactttttgcaatttattttctgtatctatctcacatcaaggattcagtcgactaacaagaaaattagccaactgcctcgtgaaagaaaagaaatagtttataattcaccccaccctcttgtactttcacttggattgcctaaaactttgtcggatcatcaaaaatgacctaaggaacaatagtcattgcctcgccatgttcgtttctcatttattggtaatttagggccataaaactggaactccgtccgattcccagattttcgtatgctataacctacgccttcagtatgggctcgggtcaccggacctagatcgccttaaattttgttggaccataaaaagcgttctaatgaacaacagtcaccacctctctatgaccgttcctcattctttggcattttatgaccataaaactgaaattgcgctcgattcccacatttacatatgctatagcccacgcctccagcatgggcccggtcaaccggatccggatctcctaaaattttatcggacataaaaaacgagctaatgaacaatagttcccatctcgccatgaccatttcttattttttggcattttagggccttaaaactagaatttcgcttgattctaaattttcatgtgttatatcccacgtcttctgcatgggcccacgccaacggattcggatcgcgtaaaattttttcggaccatcaaaaacaacctaaggaataatattcacctcctcgccatatacgttcctcatttttgccattttagggtcattaaactggaatttcgtctgattctcataatttcatatgttatagcccacgccttctacatgggcctaggccaccataccgggaacgtctaaaattttaccgggccataaaaatgacctaaggaacaatgctcatgcctagacatgaccgttactcgttctttggcattttaagcccataaaaatagaattccacccgattcccaaattgttttgtactatagcccacaccttctatatgggccatcgcctaaaaaatttcggaccataaaaaatggcctacgaaacaataatgaccgcattgccaagacttcgtgtgttatagcccatgccttttgcaagggcccggatcgcctacaattttaccggactataaaaaaagatctaagaaacaatagtcaccgcctcgccatgaccgtttcatattttttggtattttaaggtcataaaactagaattttgcctgattattagattttcgtgtgctacagcccaagccttcttaatgggcccgggctgccagactcggatcgcctaaaattttatcggaccgtaaaaaaataacctaaggaataatattcactgtctctccatgaccgttccttatttttgacagtttaggtctataaaactagaattccgatcgattccaaattctcgtgtgctatagtcatcaccttctgtatgggcccgagacaccagacctggatcgcataaaaaatttccagaccatcaaaaacgacataaggaataatagttaccgcatcacgatgatcgttacttattttttggtattttaggaccataaaatagaatttcgtccaattctcagatcttcgtacattatagtccatgcttttggcatggacccgggccaccggaccaaaatcacctaaaccttttggaccataaaatggatctaaggaacaatagcagccgcctctccatgatcgttcctcattttatggtgttttagggctataaaactaaaattttgcttgattcctagatttttgtgtgctatagtccatgccttctgcatggccggggccaccagacacgtatcacctaaaaaatttgggccgtcaaaaacaacctaagtaacaacagtcactgcatcgccatgaatatttcttgtttttaacattttagggccataaaattagaattcatcctaattcccaaattttcgtgtgttaaaacctacgccttttgcatgggcctgttcaccgaacccgaatcgacgaaaatatttttgggcctccaaaacgtcctaaggaacaatagtcaccgcatcgccatgatcattactcatctttggcgttttagggccatacaactggaattttgctcgatttctagattttcgtgtgttttagcctacgtcttctgtatgggcccggaccactagagttgaatcacctaaaattttatgggacaataaaaaatgacctaaggaacaataagcattgcctcaccattatcattccttgttttttggcgtgttagggccataaaatgagaattccgtctagttccgagattttcatgtactatagcccacgccttctgcatgggcccaggccactggacccgaattgcctaaaattatgtcaaaccatcaaatacgtactaggaacaatagtcactacgccatggctattactcattctttggcattttaaggccataaaaccggattatcgctcgattcccagaaattcgtgtattatagtccatgtcttctgcatgagctcgggtcactggatccaaatcgcctaaaattttaccggaccataaaaaatgaccgaagaaacaatagtcatctccttgccatgaccgttcctcctttttagcattttacgttcataaaactataattacgcccgattctaagattttcatgtgctatagctcatgccttctgcaagggtctgggacaccgggcccggattgcttaaaatttttcagaccatcaaaaacaacgtaaggtcaatagtcaccgcctcgccatgaaagttcctcatttttgagcattttagggctataaaattacaaattcattcgattcttagaattcggtatatcatagcccacgccttctacatgggcccagaacatcagacccagatcgccaaaaatttatccggaccataaaaaaggacctaggaaataataatcacctccttgtaatggtcgttactcggcctttggcgttttagggccataaaactagaattccacccgatttttagatttttatgtgctattgcccacgccttttatatgagccccggtcatcgatacccatcgcctaaaaattttccgaatcgtgtggaatttttgcggaccatcaataccacctaaggaatttagaacgatcccaagattttcatatgctattacatgtcgtctgcatgaatccgaacaacccgtcgcgaatctcctaaaattttgcgggcacataaaaaatgacctgatgtacaatagttatcgcttcgccgtgactgtttctcatttttggcattttagggccataaaataagaattaaggacgattcccgaatttttctcccttgtttttttagcgttttagggctatataacaggaattcaggacgatttctaaatttttatgtgttgatgtccatgccatcttcaagaattcgaatgaggggcttcaaattgcctaacaaaatttggtcccatcagaaatggcctcatgaacagtagtcatcactttgtcatgagcattcctcaatttttggcattttaggaccgtaaaataggaattcaggatgatttttaatttttttttggtgctaatatccacaggatcttcctgaattaggttgactgtcttcgaatagcctgattttatgggcctatcggaaattatctaataaataatagtcattattttgtcgtgactgttcctcgttttttggcattttagggccatcaaataggaattcaggacgatttctaatttttcgtgggctaatggtcacgccatctttatgaattcgagtgcgggcttcgaatttctaaaaattttgtgagtccatcagaaattacctattgaataatagtcatcattttccatgattgttcctgattttcatgcattttaacgctataaaacaggaattcagaacgaattcagatttatcgtgtgctaatgtccacgccctcttcatgaattttggcgacgggctttgaatcaccaaaacttttgacggcccataaaaaacgacctaatgcataatagtcatcgctttgtcatgaccgttccttgcttttttgcattttaaagttttatgggtccatttagccaatcccattttttttaataaagtgcacatcacacaccaatatttacttgccatgtgtcaaaattcatttaattattttttatatgttattttattttatttatttatttctttctttttattttcaattcctttctccttctatttctatttcccctaacctccaccttctggtccttgtcaaccaacctcaccggagagctcttgtccaccggaagtggagatcagcaaacatggaaatcaaaaactcctttcgctcaactaaagctctccaacaaggaaaaaagccaccaaaacccagcaccagaatcgtcaaactctctcaaattgctcaaaccatattcaagccgacaaaaatggtgtttatggaaagttgaaatttaaacttagtttttgtttcccggcaacaattgtatctttttttcttcgttttatctctttcccggtcttctttcttcttatttgatctccccgtcggctatcggagcctatttgatttaaaatctgaatatagtttcttatttttatttatctgttctagattttaatttatgatattgaagcagctttattattaaaatctacaagttaaccatgatgaaagagaaggggacctaagagggaggggtttggggagggaggtatgaagaaggagaagacaagaaggagacactacacattaggggtgggcatctatagggtaaaaccgataacccgaaccgttaattgcttattgggttatcggtattgggttattgggttaatggttcggtaatgggtatcaaaaaaaaaattattgggttatcggttctgaatcgatttagcaattctgttattgggtaaaccgataacccaataaggatttatacatttactagtttacccttagtgcattgtaaaatgtaactagaatagagtttcattttcagtttctcaactaagacgcaaaatagtactacgcccgatgtcagtttgagtacaaaatggagaatattttgggaccagtggattatttaatagtttggttcgaatgcatatactgcagctatccttcgttgcataggaacagggataattttgattcaatattgggttactgtaatgatgaattagtccagtgcttgtgcaaaatcttgtacattttgtttaatggtaagcaaagttgtactaatcacaagcactaagatggtgcatagtgtttacaactgtaattttcttgtgcgttactgcgttctacttgaattttcttgtgcgttctgcttgaattcccaacagcagtcaacttttaattttagttttaccttatcgggtaaaccgataactcaaccgataatgatcaataaccgataaaccaataaccgataaccaatatcttatcgggttggttatcgggtgatgatatttgtaaaccgataaccgataggcaaaatcgataattttcaaaacccaaccgaaccgaccgatgtccacccttactacacatctgtttgggttcacacgaaagagatgataaaaaaataaagaaaaggggataaataaggaaaaaaaattaaaaagggatatagataataaatttaaacaataaaaaactataaaattttaaccctttttttgtcttcaatctctttaggagagtgataatcacgctcaatgctacataggcttaaaaggtggtatttattatactttgaacggaaaagggtcatatatgccagtgaactatgtgagttaggacagatatgtccatcgttaatagtttggcacatatagtcccaatccgtccaatacttgctcattcatgccattggtttaacagaactactattttatctttcttaaataattaataaattgtatgataatcatatttatttatttgagtaatttgataatcgatttttttgttatacatcatttcaaaaagtaatcatactaaaagtagtaattgataattatttattattttaacaatataatattcgaactagtttgtgctttcttcaaatattttaccatctatttttatttttctcacaatctatttatattttttaccaattcgtttttattaattaaataacaagtcataaattcaactttatgttgtccgacataactaagctctcatctttttttttttgacttagtttttttttaaatgtgaaaactactcatatgtaatttttttcttaaattagtggcttaacttcttccaaacttgcataactctcaatctcaattttgattttgtgtaatgacccgacccgtcttttattgcatttcagtcccgttacccccgtaaaatgtttccccgtgtgttgatatccgtgttggatgagtttggagtggttcgggtgaaatctagagtgaaatgagacacttagtctctttaaggaaggtttaaattgaaagagtttacccaaagttgactttcgggttagagggctcggaacggatttccgaccgctcgactagttccgggaagtgatttatgacttaggagagaaaacggaatcgaatttggaggtccggtgtgaaaattatctaagtttgccgaagttggaatttgaaagaatccggtcaataggtgagaatttgatccgggggtcggaatgaaattccgacagttgcattagctccgttaagtgatttcggacttgtatgcaaattttcagataattcggagatgtctaagtcgggtttttgatcgggtttgcattatgaaagtttaagttcatttgaattgaatccattgaatcttggtgatttttgatgataaggtaggtgtttttatggctcgagcaagtttgaatgatgttttagaatgagttggtatttttggttgaggtcccgggggcctcggggtgaaatcggatggtaatcggagaattttggaaaaattagcagtctgtttctggtgtttccgctgaagcggaaaagagaccgcttaagcggtctcgcagcagcggaagaagagccgctgaagcggctgggaccgcagtagcggaaaaaggttccgcaacagcggaaccgctgaagcgggaaatcgaccgctgaagcggtcgctgggcttcgaaggagaaaccgctggagcggaattatttccgcctaagcggagccgcaggagcggaaaaagatccgcaggagcggaaatcgctgggattaaaatttggcagagtgttaaaacactcattttagaagagagtaaagggagctcagttgaggcaactgttggggcgattttagagagaaatcaagagggttcctcaggtaagcttccttagacttcgagtatgtgattatggtgttaattcatgattttaacactaagaaatcaaggttttaagggttaaaaatggaggttagggcttgaaacctacaaggttttaaatgtggatttgaggggtcaaatggaccccgattttgatgaaattggtatgtatagactcggggtgagatgagggtcattttgatgtaaaattttctggatttcgagacgtgggcccggggctcgggttttgtcattttcgcgaattccaatgcttttcgaaatattttgattgggttatgttccattaacaccttgtgatatattgggtgtgattttggacagattcgacgttcgttggagagaagtcgaaaggaaaaggcattgtgggctagttcttcggccatttcgaggtgagtaatgggcgtatatcttatccgagggtatgaaacctcgtattatcacattgtgaagctactgtgagctgaacacgcactccgtggtagtgcggggtcgcatatgttgtgaagtgtgattcggtcttcaatccgagaagtaacctacattgtggctagcacttaaagtgtgctcatattgatgacatatgggcttaaagccatgtctggggccacgtgccgatatgtataatcccatagggattgttataggcttgatgccatacttggggccttgtgccgaattgtaatccttcagggatatgtttattcgcattgttatgacatgcatatcataaatggaaacggtggtaactattgacaccgtatatgtgaatgaaagcagtggtaactattgacactgcatatcataagtgaaacggtggtaactatagacaccgaatattatcatgaaaacggtggtaactattgacaccgtgtatgtgaatgaaagcagtggtaactatagacactgtatgttatggcttagcattatatatattacgggtcattatatgacattaccttcagttgattttcatggatagctctgggaattgcactgtgcaggattgctggatagccttatattgtgttttactatgtttccttctttcgggttttatatacccttattactcactgagttggtagactcacccattacttcatgtaccttgtgtgcagatccaggtcatacccaggcgcagtagttctttggaggacagctagtaccagtcaggagtgttgaggtagctgcacggcgtccgcagccatcaactctctttctctatgtccttattttgtattccagtgtactttccagtcatggacccatgttgtatcatacttgatatatgtcttagaggctcagacttgtgacaccggttcctaggatgttgttattcatattttgtatattattatcggagatttggtatttaatggttcatccttgccatttgggcggtgtatgggtgttatggtcaggcttgcctagccttgcggccgggcgccatcgcgaccgggattttgggtcgtgacaacttggtatcagagcctaggttacttggtctcgcgagtcttgagccggtctagtagagtcttgtggatcggtacggggacgcctgtatttatcctcgaggagctacagaactttaggaaaatgtttcaccttcttggaattcatatcgtgcgttttgttgacctgggaactaaactgttgttattctactctctctcgcagatggcgagaacacgatctaccggcagaggtggacgacctccagtgccacctaccagaggccgtggacgcggtcgtggtcgcggcagaggcagggccacaggagcagcgcctattgatcctccagtagagcctactactatgcctggacttcaagagaccttagcccagatattatcagtatgtactgggttggctcaggtagtatcggctacagcagcagccacttcccaggcaggggatggtcagcagacccctgcaggtcagactccagagccgattattcagggcctgcagactccagaggcagcccctattgctccagttgctcgagcagcaccagttccacaggttgctccagttcaggagagagcagttccagttatgggggacgatgagcagcgtcgtctggagaagtttactaggctgatgcctcctacattcagtggggcgcagggcgagaatgcccagggatttctggataaatgtaagcggatgcttcgtacagctggtattctagagaccagtggtgtgtctttcactaccttccagctacaggacgcagcttttgactggtgggaggagtatgagcgtcgcaggccagttgacgcagctccactatcttggcaggagttctccactttatttttggagaaatggttaccattctcgcaaagggaagatctgcggaggcagtttgagcacttgcagcagggggatatgacagtgacggattatgagaggaggtttacagtgttagctcgacatgctccttctatggttcagtcggatagagagaggatccagaggtttgtggacggtcttatttatcctattcgcgtcctgatgtcgcgagagaggttgtatagccacacctttggagaggcagtagatattgccaggggtattgagtcagatcgccgcagagagcgagaggagagggaggccaagaggcctagaggttcaggaggtttcagtggtgccccatctaggggtcagatccagcagggcagaggtcgctctttcaggcctcctcagtctggacgagcagagtcnnnnnnnnnntaactattgacaccgtatatgtgaatgaaagcagtggtaactattgacactgcatatcataagtgaaacggtggtaactatagacaccgaatattatcatgaaaacggtggtaactattgacaccgtgtatgtgaatgaaagcagtggtaactatagacactgtatgttatggcttagcattatatatattacgggtcattatatgacattaccttcagttgattttcatggatagctctgggaattgcactgtgcaggattgctggatagccttatattgtgttttactatgtttccttctttcgggttttatatacccttattactcactgagttggtagactcacccattacttcctgtaccttgtgtgcagatccaggtcatacccaggcgcagtagatctttggaggacagctagtaccagtcaggagtgttgaggtagctgcacggcgtccgcagccatcaactctctttctctatgtccttattttgtattccagtgtactttccagtcatggacccatgttgtatcatacttgatatatgtcttagaggctcagacttgtgacaccgattcctaggatgttgttattcatattttgtatattattatcggagatttggtatttaatggttcatccttgccatttgggcggtgtatgggtgttatggtcaggcttgcctagccttgcggccgggcgccatcgcgaccgggattttgggtcgtgacattttggatacttcaagagtttgggttgcatttttgatccacttatcgataataggctatatagatgatatttacaccctaaatgtaccatgctttagtgttgtttgaaaggctaaatgataacaaaatgctctaattggtgcttttttgcttcgcagggattaatccaagttaggaagaactatggagtgttttggagtcaataatatgaaaaaaaggccaatcaagaagcacccgagcggaaagaagcaaataagagcactagtcttgagccaccgcgaccgcggtcgaccgcggctggaccgcggtaggctattgaagcgaggcagaatgattgtttctcaccgcggtcgcgccgcgttttgccgcggacgcggtgaactgtacagctgcccagaacttttgggaccaaagtgtaaatcggggaaaacttattccaaacccttataaactcaagaagctctcccaagaaagtttttaagcttgtttttagactactttggaggcaagaataggtgtgaaaagagcaaccaaacattagagttttttctatcttctctttatcattgcaattacacattataaacaatttagtagttttatctttttttgttatgagtagctaattccttagtctagagttttgatggaacctattgaaggatgaacttcttgttatgttaatattgtttgcccagtttaatctttatttgttcaactacgttcttgttgaagttaattgagaaggatccttaattagctgtgcctatttagtgtgcataactcgggagagagtacatatttaggtaattgttaaacaacaccactcccaaagtatatgagggatcaataaccgagggtttaaaggcaagattagggataacgaagccttgaatgcaatctaaagtgagttgtaacacataaagccagctagcgtaactcgggagagtgcgtctagtaaattgtcgtgattactcggtgagatttacaataataagagtgctcatgattgatagagacgattaggcgaatctatgtgaaacataaccggaagggattctatcaataggagaaatcataaccttagatccttctcttaattgtttacaacttaatcatagttagtctttatttgcttaattacaatcagtcttagttagtagaaacatcctcagttgttattcaaaacatttggaaaattgattacgtagaattgcgtaagtctaacgagagtaattgataggttaattccttgtggattcgactctaggctaaatactcagattatatttacaacgtccgcgtgtcctttttataagtcatagttgagcgtgatcaaattttaacggcattgccggggaattaacggtgttatcaattacaattgaaagaaataaaatattttttagtgtagtcagttttctctgtacccaatctatacattgaaattttaacgtttgttcacttggttgtacaagtgcatacctagaaactcatcgagaactggtgaagtatttgaagcattatcagatctcgagaaagttttcacggccttgaatcgggccaacgggaaaaacaaataactgaacaattcgaaccagacatgggggatcacatagtagacccagctgcgccggtagcgccggtagcgctagtggcacctcttgtgccagaggttgcgctatatgactggacccacaatagataacttggccccaacgattttagtcccgcagatagaggctgaatcgcttcaaatcacgaacaacatggtgcacttattgcaaaataagggactattttcggggtcacaagtcgaagatcctcaacaacatttgaagaatttgctgtcaatctgcaaaactcaaaggcagcccaacgtaactcaggaagcaatcaagttgttattgtttccatgctcagtgataggagctgcccagacctagctaaattcactccccattaatttcataacaacttgggaggagttagtcaagcaatttgtgaacaagtttcacccacccaacaagactgctcaacacattgatgaaattttgagtttcaaacagagaccaatggagacactgcatgaaatatgggaacgattcaaaggggtgatgattatatgtctgcgccacgatattccagatctaatgttggggcagcaattttacatgggtttggcagatggcgtgaagggtaatgttgatgcttcagttggtggagcattttttagaaaaacatggagagaaggccaaattctacttgacagcatggcacagaatcgaggtggataaccaggaattcacctatcactctagtagttcactcagtgcccttagatctatccaacactcttgctgaaaatatggccacattaatgacgcaaatgagtatactcaccaaaaaggtggaagagtcagggcaaaagcagcaggtacacattgtagatactagcaatgggggcttatgcatatcttgtcagccagttggtcagtggaatgcaaaaagtgatcatcatcactaccctgaggacatgaattatgtgtctaattatggaggccaaagacagggtggtcaaaattagggacaacaaaatcaaccatacgggccagtccagccacaactcaacaatggaaacatgggaggtatgagacctcacaataatatggcgccttaccaaaggccacagggataaaataatcaaaatcagcagtagggttatcatcctcctcagcagaagcatggtggaagacaggaagatgggtttggtagactcgaggtaatgatgcagtaggttattgggtcaaatgcaaaaatcagtgaaagagtagatgcacatgattcatctattaagaatattgaagtgcagatgggccggatttcaatggttttgaataatcgtcctcatgggacattacctgcagacactcaaataaatccaaaagatcaaggcccgaagcagctgatggcagtgagtctacgtaatggcagagacttagacttggagaaagagagggctcgagaaagcagacatactgagacacttgtaccagtgcccattgagctagatgagtcaacaaaactgaccgaggtgacagtacaacctgcccaggaagaacataacacacatattgaggctgagagagaagctgagatagcccaggaaccgatagttgaggtggtagctgataaacaaaatacctaaatcattgggaagaagagaccccttgcaccattcccacagaggctggccaagtaccaaaaagaagagcaatacaagaaattcatggagatgctgaaacaaatccaggtaaatattctattgatagatgctttgaaggagatgcctggttatgcaaaaatgatgaaggaattgatgtcccgaaaattcgatttccaagacttggccacggtgactctgactctgacctgcagtacggtggtgacaagactaattgctaagaaactatctgacccagggagtttcacaattccctgtaccattggaaattttgcttttgccaaagcactgtgtgatttgggagatagcataaatcatatgcccttggcgatctataagaggttggggattggaagatctagacccacttctatgttgttgcagctggctgataggaccgtgaaaagaccttctggtatcttggatgatgtgttgattcaggtagggaaatttgtgttccctacagattttgtgattcttgattgcaaggtggatgaagtgattccaataattttgggaaggccgttcttggccactgagagagctctcattgattgtgagactggggagctcaagatgaggttgaacgatgaagagataacattcaatctacagaaatctatgaggcgacaagtgaattctccaattgttctcttattgatgccgtggatgtaatcgtagaagttgatgatgagatgctgactattgaggaccctcttgctgcatgtctggtaaatttagataaggtgaatggggaagaactggtagaatgggggttggctttagagggcagagggttctgggatagaactcttgaattcgagcccctgcacttagaaaacatagaaactcctccagccaagccttccatagaagaaccaccaaagctggaatcgaagccactgcccgcccatctcaggtataagttcctcggacataactccacattactgttattatctcatctggtttgttagatgtgcaggcaaaacaacttttgcaggtactcaagaagtgtaagacttacattgggtgaaccatgtcagacattaaggggattagcccagcttattgtatgcataaaattctgctggaagagggacacaaaccctccaagaaacaccaaagaaggctgaaccccaacatgaaggaagtggtgaagaaagaaatgataaaatggttggatgtgggaatcattttcccaatctctgacagcagctgggttagcccggtgcaatatgtgcctaagaaaggtggcatgatggtggtcaaaaatgataacaatgagctgatctatacaagaaccgtcacgggctagagaatttgcatggactacagaaagttaaatctgcccacccgaaaagaccacttcccacttcccttcattgataagatgctagacagattggcagagaggtctcacttttattttctgaatgggtactcatggtacaatcaaatctacattgcaccataggacagagagaagacctccttcacatacccatatggaatttatgcttttcggaggatgccctttggcctatgcaatgcacccgccacatttcaaaggtgcatgatggccatattcactaacatggtataagacataatggatgtatttatggatgatttctcagtggtgggaaactcttttgatgagtgccttataaacctgactcgtgtactgaaacggtgtattgagaataacctggttcttaattgggagaagtgttatttcatggtacaagagggcatagtcttgggacaccgggtatcaagtaaaggaatcgaggtggatcgtgctaaagttgacgtgatagcaaagctgccacctccaacttcagtcaaggcaatcaggagcttcctcgggcatgccggtttataccggagattcataagagacttctcaaaaattgccaaccctctctgtaagttgttagaaaaagatcacccctttttgttttctgatgatttcagggtagtatttgaggagttgaaaaagagactagtcacagcacccatcattgttttccccgactgggagcaaccattcgaactcatgtgtgacgccagtgactacgcagtgggggcagtgctgggacagtggaaagacaagctaatgcatccaatctactatgcttgtagaacgctgtgtggagcccagctgaatatactgtgactgagaaggagatgttagttgtggtgtttgctttcgacaagttcagatcatacctgattggctctaaggtaattgtatacactgatcatgcatctctcaagaacttgattgagaagaaggagtctaaaccgtgcatgattcgttgggtgctgttactgcaagagttcgacctcaaaattcatgactgtaagggcacaaaaaaccaagtagctgaccatcttccacgacttgagggagctaaaaactcaattgaggttgaggatattctggaaacctttccagactagctacttctcactacaagtcttgaggaagtgccatggtatgcagactttgcaaattacctggcacgcagtatagttccctatgacatttcctctgtacaaaagaaaacgtttcgtgactgccgcatgtattattgggatgaaccttatctgtttcgaatatgtgttgacaatatgatctagaggtgtgtccccgagatagaacaatcttctattttgcaggcatgtcacgcatcggcgtatggagggcattttggaggagtcaggacagccgcgaaagtgccggaggccggtttcttctggccaacagtgtttaaggatgcagatcaatgggtgaagggctataatgaatgtcagtgaaccgggaacatttcccatcgccatgagatgctcatgaacccaattcaagaggttggaatgttcaatgtctgggggattgacttcatggtccccttcgtcagctcctttgataataagtacatacttgttgctgtagattacgtgtccaaataggttgaagctacaacactgcccactaatgatgcaagagtggtggtggggtttttgaagaagaacatattcacccgttttgggaccccgagagctattatcagtgatggaggaacccacttctgtaatcgagccttcgagaagttgccagcgaagcatgatgtacgccacaaggtggcaacactatatcatctgcagaccaatggacaggtggaagtgtctaatagagagataaagagtgtattgaccaagacggtaaaggccacaagaactgattgggcgaaaaagctatatgatgcactctaggcttatagaactgcgtttaaaacaccaattggtatgtcaccatatatttgtgttcggaaaggcctgccacttaccagtgtaacttgaacataaagcttggtgggcactgaaacaactgaacctagacattaaggttgtgggcacaacgagaatcactgaattgcatgagcttgacgagttccgatatttggcttttgagagcacaaggttgtataaggaaagaatgaagaggttgcatgactagaacattgttgagcgacatttcaaccccggggacaaggtattgctctataactcaagattaaggctattcccgtgtaagctcaagtcacgatggtctggcccattttgagtggtcgaagtattcccttcaggggttgtagagattgtctcagagaaagactctcacacgtttagagtcaatggatagagattgaagctatatgtaggcatgaatgaaccaaaagaagtgacagagatctacctgacagaacctcggaggtcaagtgaaccgtaaatgcgcttatctgcgtcgtgacgcgatgttaaatcaggcgctgcgtaggaggcaacctatgaatgttttttcttgtttttttatgtaaccttataaaaatcatcgtaatcgcgaccgcggctcgaccacggtcaatgccaagtattctgcctcccagttgctcgacccaccgcgaccgtggtgggatcgcggtgaaacgcgaacattctgcctcgaggtatttaactcattgcggccgcggtgagactgcggtcgaccgcgacgatttgctgtttcgccgcccaggtaagtaatttcattttttttctttttctttttatttttcttttatcctctaatttttttaacccccctaataatatcaaaagaccctctcagcccctcactttccccatctcatatctctctctgaaccctaattaaccatcttctctcctctcttcttcttctttttcttcacttctctcgcattcccacccatctcccccgactcccatttgtctcactctctactcatcccaggtatggcatgattctctccctcttctattgtatttttgttttaatttttatgttagttcaatatttaattatttagtatctctagttgaatttttcttttaattctcttcttttttgctttttaatggggtatgtgcactatgttgttgaagagtgcgtgtacaatgttgtagaaaatgtggacttgtgtgtctgagattaattgttgtggggtgaattggtgaagtacaaattgttgatttgggggatgaattgatgtatccatgagggttaatgtgttaggatagtgccttgctcacaaggtgtttgtcgaatggccccaatggagttctaagggctaatgtgatcatggtagtggtgaagtctgagtaaccacccatggttcacacaactcaaaccctcaccgagaggagattctgtgtttgacaggtacaatgcatccatctaggaagagacgcaacccaaggtcctccgctagtggaccgaatagctcttcgagagctcgaggtcaagctagtgcggaacagtttgaccgcactagatttgtctccaaaccggctgaggatagttagaatgccaaggcgtcaaagaaattgttgccggaggtgcatactgaccgggcagctttgaaagtggaatgcccgaatatttttgttgagttgaagaggtgtcagctggacatcttctttgaggaaccagatgaggaaaatgtacagatggtgagggaattttatgctaactgcccggaacatgagaatggagttgtcacagtacgcaatccctcgaggccatcctccaagtgtaccggctaccagtattcacgggagagacatatacttacattgcttatcatcgcccaagggtctattgggcaccaatacttgaagcaatttgtgtgcctgacagggagcatatatggataaagcatcatatcacattgaactcacagtatctcaattgggaagctaagtgttggctcaccattatcaacagtcgttgctaccctccagcaatatgaccaatgtcaatgggccacgagcagcagctatctaccgttttatgacccaccaggactttgatgtcgccaagctcctacataatgagatgtccgttcgctccccagaggtactcaaagtattttacttcccctctctggttaccaagttgtgccgtgctgcaagagtctctgaaaatcccagaatagatgggaaattgccatcgaaagccccgttttgggctagcaaaatcacaattgggagagagccggtagtgatagttgaggaggatgatgaagctgaagaggatggtgctgtcccaccaccgccgagagctgatgaggcgggcccatcacaggcccaccgaagtacccgcctgacagccctggaataagaaatggctggtctccgcacttctgtcactgtcttgggcaccaaagttgacactctgaccactcaacatgccaagttggagaaaaagattatggtatggcttcgagcgttaggaaaagcatgttacctcgatcctggtaccgtctctaatcaggattgagcttcatggaagtccctgtaccttgctctgctttatatttgttgacatggagacatgccaaaattttaagtgtggggtgggggatggctgttgttgtaaaaaaattgtataactttgtatcgttgctttctttttgattgtttggtattgtaggatcatgttagttaacttcgacttggctcgaagatggacacctttcgacaggtctcttgagggacattagtcgaacaaaaaaaagggaatataaggactcttcctgatgatggatcctttagacaatttcttgagggaagtaggcctagagaaaagaccaaaaagattttttttattttaggtagtgtagcaactcccccttgattattctttgggtcatggttctttttcaagggtttagcttgaaccaggtgtaggtagtttttgtttattttgtttttagttttaagttagtattgatgggctatgagctgaaatagaaagagaaacccttggctaacatacacctgaatatagtcgacactagagtgtaatgcttactctcagtggttgactcttgctaaagtgccttaaatttgtatgtttgtaactgacttgaacactcaaaagagagtgtcttgataaaccaatctagagtgagtcatgtgccatgtgtgtgtgagttttactgtattctatgctttacatttgatgcctagaactttccatgtgtgtctgcaaagcaaaatagtagcttcattcagtcttagaagtaataggcatttctttgttaagccggctatataaagtaaacccacctaaatgtaatacatcgtagttaaccccgttgagcctataagcctggttctttggcaaccacatcgcgaaccttaaccaattgttttttgaatagccatctgtttgaaccctttttatcccctatgagcacttgaatggccttgaaatatgcaaaagttaaagtgtgggttggtggtttggtttttaagtggaaccaatgaaatagagaaaaggtgtagtttttggaaaagtaaaagaagaagcaccacttaaaagaaatctttaaaaaaaaaaagagagaatgaataaatgtagtagttgataagtggtggcttgatacaaatgcacctaaaggaatgggatgttataaataaaaatgtggtggaacgtttggttgacataagtatgattttagagattaatgtgattgtattaaaatgcttagggaggttagtcactatatccaaatatatcctacccatcccttagtctacattacaaacaagtgaagtcctaattgatcttacactgaataggctcgattagtagagtagtacactacgggcaagcctctggtgcatctttgtgacatgtgaatgttctttttgagagtgagcaaattttgtctatttgagttcctaattgttcttaataatattatttgtggaactactctcttgtgtgacgtgaggacatatgattcacgaagtaaaggtaagtcttgacctctgtatagagtagtttgagtaactacgaatattgcacgacatgtgatattcgacttttgaggcaaagtttgttcactactaggtgcaactttggtgaattattctttgtgtgatacattaagggaaaagtttggggaaggaactttgatagagtatggtggattgctcgaggactagcaatgatttaagtgtgggtgtagataataggctatatagacgatatttacaccctaaaagtatcatgctttattgttgtttgaaaggctaaataataacaaaatgctttaattggtgctcttttgcattgcagggattaatccaagttaggaagaactatggagtatttttgagtcaataatatggaaaaaaggccgatcaagaagcacccgagcggaaagaagcaaacaagaggactgggcttgagccacctcgaccgcggtcgatcgcgactggacctcagtaggctattgaagcgaggcagaatgattgtttcttaccgcagtcgcgccgtgttttgcggtggccgcggtgaactgtgtagctgcccagaacttttgggaccaaagtgtaaatcgaaaaaaacttattccaaacccttataaactcaagaagcttgcccaagaaagtttttaagcttgtttttagactactttggaggcaagaacaagtgtgagaagagcaaccaaacattagagtttttcatatcttctctttattattgcaattacacattatgaacaatttagtagttttttcttgttttgctatgagtagctagttccttagtctagagttttgatggaacctattgaaggatgaacttcttgttatgttaatatagtttgcccagtttaatctctatttgttcaactacgttcttgttgtagttaattgataggatcctcaattagttgtgcctatttagtgtgcataacttgggaaagagtgcatgtttaggtaattgtttaacaacaccactcctaaagtatatgagggatcaataaccgagggttttaaggcgggattaaggataacgaagccatgggtgcaatctaaaatgagctgtaataaacaaagccaactagtgtaactcgggagagtcatctagtaaatttccgtgattactcgggagagatttacggtaacaagagtgctcatgattgatagagacgattaggcgaatatatgtgaaacataaccggaagggatttcatcaatagggaaaatcatagccttagatccttctcttaattgtttacaacttaatcatagttagtcttatttgcttaattacagtcagtcttagttagtagaaacatcctcagttgttattcaaaatgtttggaaagttgattacgtagaattgtgtaagtctaacgagagtaattgataggttaattccttgtgggttcgactctggtctaaatactcagattatatttgcaatgtccgcatgtcctttttataaggcatagttgggcgtgatcactgatttacataattttgattcaatagtaaattttgagtgatcacgagtttcaattctatataaggaacagtttccaagattacatttgttatagtggaaaaactggaataaaggagcccctgccaccatatcttgatccaagagaccaagattaatgtttatactaaatcaataaaatacacaacttgtgtatttttatttatgaaataattaattaataaaaaaatatttgtgaaaatatatattaaaataataaataattatcaattactacttttagtaggattactttccaaaataatgtataacaaaaaaaatcgattatcaaattacttaaataaataaataagattatcatacaatttattaattttttaagaaagataatatagtagttctgttaaactaagggcatgaatgatcaagtattggaaggattgggcatatatgtgccaaaatattaacgaaggacatatctgtcctaattcgcatagttcactggcatatatgacccttttccgtactttgaataaagacaatgccactatttcaacagcactgggtcaatattgcgctaaaaaccaacccaagggtacttttgctatattttcaatagtttaagggcgaaatctagccaatattgtaaacaacaatgagtcaatattgcacgaaaaaacaaatgaagggcactttttctacattttcaatagtttaagggttaaaatagagacactattttaatagcactgggtcaatattgcaccaaaaaccaaacaaggatacttttgctatattttcaatagtttgaggggcaaaattgcacaaccattttaatagcaccgggtcaatattgcaccgaaaacaaaaggaagggtactttgctatatttctaatagtttaaggggtaaaatggagcaactattttaacagcaccgggtcaatattgcaccaaaaacaaaaggaagggtactttgctatatttctaatagcttaaggggcaaaatggagcaactattttaacagcaccgggtcaatattgcactgaaaacaaaggaagggtactttgctatatttccaatagtttatggggcaaaatggagaaactgttttaatagcacagggtcaatattgcaccaaaaaccaaaccgaggtactttggtatccatggtgatgcgctcccacttccactctggtataagcatctgctgaagtaggccacccggcccctgtgttcataattgacctactggtaattcaaacacctagccacatactccactatgtctttcttcattctccgccaccaataatactgcctcaagccacggtacatcttcgtggcacccggatgaatggaatatcgcgaactgtgtgcctcctctagtatctttcccctcagaccatcaacattaggaacacatagacggccctaaagccgcaaaacaccatcctcgccaatagaaacctccttggcacctccttgaagcaccgtccctctaagaactgccaaatgtggttcatcgaactgccaggccttgatctcccccaattatgaagactgactgggctttgaaatgtccaacctcacacgtctgttagccaacgactgaatgtccagctaagggcctctcctcggctggaatgaatgccaaactacccatactctctgcctttattattaaggcatccgcgaccacatttgccttgctcggatgttaaagaatggtgatgtcataatcctttagtaactcaagccacctacgctacctcaaattaagatccctctgcttgaacaaatgttgtaagctgcgttaatcggtataaacctcacattgcaccccatacagataatgcctccatatcttaagagcatgaacaatcgcggccaactctagattgtgcatatgataattcttctcatgaaccttcagctaacgcgaagcatatgcaataactcaccccttctgcatcaatacacaccctaacccaatgcgtgaagcatcgcaatataccgtatacatccccgagccggaaggcaatacaagaactggtgttgtagtcaaagttgtcttgagcttctggaagctctccttgcaatcatcggaccaacggaatggagcacccttctgagtcaatctagtcaaaggtgatgcaatagatgaaaagacctatacgaattaccggtaataacctgctagccacaggaaactcctgatctcggtcactgaggtaggacgtggccaattctgaactgcctcaatcttcttaggatccaccttaataccctttgctgacacaacatgccccaagaatgccaccgactctagacaaaactcacacttggagaatttagcatatagcttctgctctcgcaaggtctgaagcactactctcaaatgctactcgtgctcctccgggctacgtgagtatatcaagatgtcgtcaatgaagacgatgacaaatgaatcaatataagtcctgaataccttgttcatcaaattcataaatgttgctggggcattagtcaagccaaaggacatcaccaaaaactcataatagctatatctagtccagaatgcagtcttcggaacatccgagtcccgaatcttcagctgatgatacgctgacctcaggtctatcttagagaacaccctagaaccgtgtaactggtcgaacaaattatcaatatgaggcaacaaatacttgtttttgttggtgattttgttcaactggcggtaatcgatgcacatcctgtcacgccccaaaatccgagggcgcgaccggcactcaatcgggtattcccggtcgagcggacctgggtgcatttcctattccccacgcgctaccccacattattcattgttaattagccaaaagataatagatgcagctgaaagtaaatatgattcctctttggaacatcttccataaagcatacattatgattaacagggaacgtggtatacgactctcagcgcccaaaaacatacacatatgtacataagttctaacccacatcatactgtctacggagcctctaagaaggtaaagatgatacaatacttgccggtgacaaggccccggctataccttaccaaaataacataaaaccataattacaacaacagaggtggcctggaccacatagggccccggaaggaaaggggctcaccaataggaacacagctgatagaaaggaggaggggctacggacggtggactggagtgcctgctaccgatccacctacaatcataacacgaatgtagcgcccccggcaaaagggacgtcagtacatttgaattgtactggtatgaaagaactaaccctgtcccaagtaaactcaagccaagatacaaatacaacagaaagccgatgatacatgaacaattaagcagctgaacaacaatggaaaaatcaaccaaacaattcacaacagatagttcaattagccaaacaaaggggcaaccagtgccccacaggttgcaaactctcctgctgtctcctttcacaattccacatttatcatttcatgattttaaatcatttcagtagtgatattggattatttttctacccttattacctcggccacccttattacctcggtcacccttatcgcaccaacccacaccttgtttcaccgtgttgcggcgcgcaacccgaccctgcctgacagtttcaattcacaaacaacatacaacatagcaacaattacaaagaattcaactaccgcacattgtcaagatgtatccataacaaggagaaaggtgtttccacaactaacaacaacagtttcctcatggtcatgtttcaattcaaaacaacaaacaacaacttccttatgttcatcaattcgtacacagtttgagttaccacaacagttgttcacaaccaatcatatacattgttccacaatatttccgtttccaccattcatgaactctttcaattacaagttcctcaactctcagcacaagatgttaccacacgaatatcaatcacaagatgtccacaacaatccccacatggatatcaaacaccaaacaatttcacataccacaacagggcgatttcacaagattcaaagttagccatacatacctggggttgaatgtctcttctaacttctagtccaatttaccaagcaattcaagaaatcaatctagtttcatgatcaatacacaaaggtcttagaattaagctcatagttattacccaattcccattttagctagattctagggctttaaggtcatgaatgaaggttccattaatttgcatggggttccctgtcacgacccgaatttcccaccatcggggtcgcgatggcgcctactgtcggagctaggcaagcctcttagcaagaattaaacaactatgaattttaacaaattaataaattgaaacagtaagtaataataaagaagtctcaaacttaaagtaatgatagaaacaataatgcgaaagtagaaacaactggaatcctctacccagaaaacagtgtcacagcactcacggacatctacagatttactacatacaattgtctgaaagaaaagaaatacatagatcgtttgtctgaacaagaaacaaactacataatgagaggagactgaggggcccacgaacgccagtaagctacctatcagtctctggactgaaggcgtgctccctatctactgctgctgcggcgctccgaaggctgctcccggatctatgcacaaaggggcacagaagcgtagtatcaacacaaccgaccccatgtgctggtaagtgcctggcctaaccccggcgaggtagtgacgaggctagacaagacctaccgcaaataacctgtgcaagatatatttatacaattgcaggaataataacagaatacataatcaaacggggagggaacattctatcgggggaacagtaaaggcaggaagagcaagtataacacaataataaaactgcatatttccaaacaaagtcaaaacacatagtggacagcgcgccacacgatcccaagttcagtatacaatagtggacggcgcgccacacgatcccaagttcataatacacaggtggacggcgtgccacacgatcccagaatatgatatacaagtggacggcgcgccacacgatcccaacaacctggagtaccaactctgttcaatcacaaataggccccttttggggaaaataacaataacatctcaaaacccggcaagggtacagctatcaaccaaaatatcccgacaagggagagtctacgaccaaattctacgcatttcggcaggtatatacacactaagttcttctttaagtcgcattatccttttaacttcaaccattcatatcataggagtcagttcaacaacaagaatctatatcacaacattgaactaaggcaatcaagacccacggtcatgcttgactcgggcgcataggtaaccgtcaccaaacctatacaccgacaccacatagcacatagaaaataatgtcctaatcctaatccctcaagccaaagttagatcaaacacttacctcgatgccgaaactagcaatcgagcctctaacatcgcctttcctctagaatccgacttccgaacaacgatatctaagcatatttggattcaatagtatcaataatagctcaaaaacaccaacccatagcttagaaatgcatttcctaactttcttccaaaaattccaaaaattccaaaatccgacacctggcccacgtggtccaaactcgaggctcggaccaaaacccaatcccccatatccccacgaattcaaatatataattagattttaaattcgacctcaaattgaggttctaatgcccaaaattaaataaaccctaactaaacccaaaacccctaaattctagtttgattttatgttttagggttaggtatttaatgatctgatgaagaaatattgaagaaatgaggttaggattaattacccaaagaacaatgaagaaatggaagcttgattctcgtcaatggaggtttttggaagagggttcgagtgaaaaagatgagatagcctcggaccacactgttttgaacttaataaaatcgctgggcaaaattggtctacgcaatcgcgtgaactgggctgcgatcgcagtgaggaatgatgcgatcgcgtagaggaaatactggggggctcaactttggtctatgtgaccgcgtgagtctatacgcgaccgcggaggaggagagtcagaagctacgcgatcgcgtgaaaggctctgcgatcgcgtaggggggaagaagccacaacaagcaatcgcgtggacgaagccgtgatcgcatagaaggaaacccctgtgcaaaaactgcagaaaatctgccaagtttcaaacaccaaaaacaccccgaaccacccccggaaacactcccgagccctcggggctcccaaccaataatacacactaactcataaacatcctacgaactcactcgagcgattaaatcgccaaaacaacatcacaatcaatgaatcaaaccctaaaatccattattttccattttagacttcaaacttcaaacttagttttataggtccgaaatacgccaaacgacgttcgatttcgaccaaactttacagatagcgcttaaacatagtataagacctgtatcgggcgtcggaaccaaaatacgagcccgataccttagttttttatcaatattcatttccattatctttaattaatttcagaaatcaatttcacagaaaaattcatatcttgggcctgggacctcggaattcgattccgggcatacgcccaagtcccatattttcctacggatttttcgagaccgtcagatcatgggtccgggtccgttttcccgaaatgttgaccgaagtcaaccatatcaatattataatcaaatttcatcagatttaacacagaattctaatttcttaacataaaaactttccggcttcatgcccggactgcgcacgcaaatcgaggcaaccccataagaggttttcgagacctcggaagcacggaaaaggaaggatttacggtgatgacccgttgggtcgtcacaatctccacctctaaaacaactgttcgtcctcgaacggacaaaagaaagaagcacctgagtcgggaaacaaatagggataacggctccgcatatcggactcggactcccaggtcgaagcctcatgaggctgacctctccactgaacacgcactgaaggaaaactcttcgacctcaactgtcgaacctgccggtctagaatagccaccggctcctcctcgtatgacagatctttgtccaattggacagtgctgaaatctaacacgtgcgatggatcgccgtgatacttccggagcatagacacatggaacactagatgcacggctgataagctaggtggcaaggcaagtctataggccacctcacccacacgatcaagaatctcaaatggaccgatgaacctagggctaagcttgcccttcttcccaaatctcatcacgcccttcatacgcgacacacggagcaatactcgctcaccaaccatgaaagcaacatctctgaccttgcggtctacataactcttcggcctagactgagttgtacggagcctatcctgaataatccggaccttatccaaggcctcctgaaccatatctgtacctaacaaccgagcctctcctggctcaaaccatccgactggagaccgacaccgtctaccatacaatgcctcatacggagccatctgaatgctggactggtagctgttgttgtaggtaaactctactaatggcaaaaactggtcccacgagcctccaaaatcaatgacgcaggctcgaaacatatcctcaagaatctgaaccatcctctcgcactgaccgtccgtctgggaatgaaatgttgtgctcatctgaacctgggtgcccaactctccctgcaaggctctccagaaatgcgaagtaaactgcggacctcgatccgaaatgatagatatggtaaccccatgaaggcgaacaatctccctgatataaatctcagctaatctctgggatgaataagtcacggccacaggaatgaaatgcgttgacttggtcagcctatcaacaataacccaaactgcatcaaacttcttccgagtcaacggaagaccagtaacaaaatccatggtaatcctctcccacttccactcgggaagctcaatcctctgaaatagaccaccgggtctctgatgctcatacttaacctactgacaattcaaacaccgagcgacataagctactatatccttcttcattctacgccaccaataatgctgcttcaaatcctaatacatcttcgcggcgcccgggtgaatagaataccgagaactgtgggcttccgctaagatcagctctcgaataccatcgacattgggcacacaaactcgcccctgcaatctcaacacaccatcactccccaaagtcactttcttggcacctcctcgatgcaccgtgtctatcaggacacataaatggggatcctcaaactgaagctcacgaatacgctcaaatagagaagatcgggaaactgtgcaagccaaaactctactgggctcagaaatatccaacctaacaaaacgattggccaaggcctgaacatccaaggtaagcgatctctgactgactggaatataggcaagactacccatgctggcagacttcctactcaatgcatcggccaccaaattggccttccccgggtgatatagaatagtaacatcataatctttcagcaactctaaccatcttctctgcctcatatttagttccttttgcttgaacagatactgaagactcttgtgatcggtataaacctcacacgtcacaccatataagtaatgcctctaaatctttaaggcatgaacaatagctgccaactcaaggtcatgaactggataattcttctcgtggatcttcaactgcctcgaagcataggcaataactttgccattctgcatcaatactgcaccaagcctgatacgggaagcatcacaatagaccgtgtacggtcctgaacctgtaggcaacactaataccggtgtcgtggtcaatgctgtcttgagcttctgaaagctcgcctcacactcgtccgaccacctgaatagggcacccttctaggtcaatctggtcataggggatgctatggatgaaaaccccttcacgaaccgtctgtaataactagctaaccccaagaagctccgaatctctgtagctgaagctggtcgaggccagttcttgactgcctctatcttcttcgggtccacctgaatacctgctgctgacacgacatgacccaagaatgcgatcgaacttaaccaaaactcgcactttgagaacttagcatacaactgactatccttcagagtctgaagaaccactctgaggtattgctcatgctcctcctggctgcgggagtatataagaatgtcgtcaataaagacaatcacaaacaaatccagatatggcctgaatactctattcatcaactccatgaatgctgctggggcattagtaaatccaaacgacatgaccaaaaactcgtagtgcccataccgagtacgaaaagcagtcttagggacatcagacgccctaatccttagctgatgataaccagacctcaaatctatctttgaaaataccttcgaacactgaagctgatcaaataaatcattgttcctcggcagtggatacttgttcttaatcgttaccttgttcaactaccggtaatcaatgcacattctcatagaaccatccttcttcttcacgaataacactggagcgccccacggcaaaacactaggtctaatgaaacccttctcaagcaaatcctgaagctggtcctttaactctttcaactctggcggcgccatgcgataaggcagaatagaaatgggctgagtgcccggcgtcaaatcaatacagaaatcgatgtccctgtcgggcggcatgcccggcaaatcagaagggaaaacctcagggaactcccgaacaataggaacggaatcaatagacgggacctcagcgctggagtcgcggacataagccagataagctagacaccctttttcgaccatgcgtcgagccttcacataagaaataacgctgcgagtggtatgacctggggtccctctccactctaatcggggcatatccggcaatgccaaggtcacggtcttggcatgacaatccaagatcgcatgataaggagacaaccaatccatccctagaatgacgtcgaaatccaccatatccaacaataacaagtcgacacgggtctcaagacccctgaacaccacaacacaagagcgatggacctgatccactactatagaatcccccactggagtggatacatgaacagaaatacccaaaggctcactaagcataaccaagtaaggtgcaaaatatgacgacacatatgaatacgtggatccaggatcaaataatactgaagcatctctatcacaaaccagaatagtacctgtgatcactgtatctgacgactcagcctctggcctggctggcaaagcataacaatggggttgggccccacctccctgaatagcatccctaggatgatctgctactgtctgacccctacctctcgctggctaactccacctctaagacctctgcctccacctctatgacctctacccctgcctctagctggctgggcagactgtggggcaggtggtgcatgaatcatgggacggggtccctgctgctgggaactgctggaagctcgggggcaatacttggcgatgtgcctcgtatcgccgcaagtgaaacgagctctaggctgctgagcataccgaagtggtgctgcactgataggtgctgaaggagaactgaaaagctgctgatcagaaaactgtgactgagaaccacgaccacctggggcaccatgagaagcctgaagagctgactaaaatggtctcggaggctggcccctaccataggaatccctacctccagacgaggtgccactgaaccgaccagaatgacatggcctcttatcagacccgaaaccacctcccagagaaagtgccatctcaatccggcgagcaccatctgccgcctcctgaaatgagagatcactaccggcactcatagctatctgaactcggatcgccggagtcaaaccatcaacgaatctccaaactctctcgccctcagtagggagtatcaaaatagcatgacaggcaagatccacaaaccgcgtctcatactgattaacagtcatagacccctactgaaggcgctcaaactgcctaaggagggcatccctctgagtaacggggagaaacttccccaaaaacaactctgaaaactgctcccaagtcaaggctggtgaccctgttggtctagatagacagaaatccctccaccaagtcttggcggatccggccaaacgaaaagtagcaaaattgaccccattggtctccaatatacctatggtcctcaagacctcatgacagctgaatagaaagttttgagcatcctcagaaggcgtaccactaaaggtaagagtaaagagcctagtaaagcggtcaagtctccacaaagcatccgcggacatagccgcaccatcactagactagcccgcaaccactggctgggcggccacaactggctgaactggcaacgctggctgcactggcacagctggctgcactgctggaatctagactggagcctgaggaactaccggctctggagtaggagtaacgggggtctggactcctcccccagctggatatgcggctggagctaccggaagcaagcccccctggaaatactctccataaaacctaccagtcggaccaaggcgtcctgaagcactagcgtagcaataaagccctctgggacttgacctgggcccactggagttactggagctggaacctcctcagcgtagtcgacatgaggctccacctttggaactgccgctcggggctgagatctgccccggcctcagcctctagcacggcctcggcctctgcccctgccagatgctgttgccgggggctcagactgactcgcggaagatgaggaagcgcgtgttctcgccatctgcgaaagaacggagtagaaagacaattagtatttgagaaacagaatcgcacgacaagaatgaacaaagtgagattttcctaactctgtagcccctgggggataaatagagacgtctccgtaccgatccctcagactctaccgagtttgtccgtgagctgtgagactcaagtaacctagtgctctgataccaacttgtcacgacccgaatttcccaccattggggtcgcgatggtgcctactgtcggagctaggcaagcctcttagcaagaattaaacaactatgaattttaacaaattaataaattaaaacagtaagtaataataaagaagtctcaaacttaaagtaatgatagaaacaataatgcggaagtagaaacaactggaatcctctacccagaaaacagtgtcacagcactcacggacatctacagatttactacatacaatgatctgaaagaaaagaaatgcatagatcgtttgtctgaacaagaaacaaactacataatgagaggagactgaggggcccacgaacgctagtaagctacctatcagtctctggactgaaggcgtgctccctatctactgctgttgcggcgctccgaaggctgctcccggatctgtgcacaaaagggcacagaagcgtagtatcagcacaactaaccccatgtgttggtaagtgcctggcctaaccccggtgaggtagtgacgaggctaggcaggacctaccgcaaataacctgtgcaagatatatctatacaattgcaggaataataacagaatacataatcaaacggggagggaacatgctatcgggggaagagtaaaggcaggaagagcaagtataacacagtaataaaactacatatttccaaacaaagtcaaaacacataatggacggcgcgccacgcgatcccaagttcagtatacaacagtggacggcgccacacgatcccaagttcataatacataggtggacggcgtgccacatgatcccagaatatgatatacaagtggatggcgcgccacacggtcccaacaacctggagtaccaactccgttcaatcacaaataggcccctttttggggaaaacaataataacatctcaaaacccggcaagggtacagctatcaaccaaaatatcccgacaagggagagtctacgatcaaattctacgcatttcggcaggtatatacacactaagttcttctttaagtcgcattatcctattaacttcaaccattcatatcataggagtcagttcaacaacaagaatctatatcacaacattgaactaaggcaattaaaacccacggtcatgcttgactcgggcgcataggtaaccgtcaccaaacctatacaccgacaccacttagcacatagcaaataatgtcctaatcctaatcccttaagccaaagttagatcaaacacttacctcgatgccgaaactagcaatcaagcctctaacaccgcctttcctcaagaatccaacttccaaacaacgatatctaagcatatttggattcaatagtatcaataagagctcaaaaacaccaacccatagcttagaaatgcatttcctaactttcttccgaaaattccaaaatccgacaccgggatccacgtggtccaaactcgaggctcggaccaaaaccaaatcccccatatccctacgagttcaaatatataattagatttttaattcgacctcaaattgaggttgaaatgcccaaaattccataaaccctaactaaacccaaaacccctaaattctagtttgattttatgttttagggtttggaatttaatgatctgatgaagaaatattgaagaaatgaggttaggattaattacccaaagaactatgaagaaatggaagcttgattctcgtcaatggaggtttttggaagagggttcgagtgaaaaagatgagatagcctcggaccacactgttttgaacttaataaaattgctgggcaaaattggtctacgcaatcgcgtgaactgggatgcgatcgcagtgaggaattggctgaagctacgcgatcgcgtgaggaatgatgcgatcgcgtagaggaaatactggggggctcaactttggtctatgcgaccgcgtgagtctatacgtgaccgcggaggaggagagtcagaagctacgcgatcgcgggaaaggctctgcgatcgcgtatgtgacgacccaaagggtcatcaccgtaattctcctttgttccgtgcttttgaggcctcgaacacctcttgaggggttgcctcgatttgcgtgcgtagtccgggcgcaaagccggaaagtttttatactgtgaaagttgaattatgtgttgaaaatgtgaaactttaagcataatattgatagggttgacttcggtcaacattttgggcaaacgggcccggacccatggtccgtcaatttctgaaaatccgtggtaaaatatgggacctgggcgtatgcccggaatcgaattccgaggtcccaagcccaagttatgaattttctatgaaattgatttctgaaatttattaaagataatgaaaatgaattttgattataaagctgtagtatcgggctcgtattttggttccgacgcccggtacaagtcttatatgttgtttaagcgatatctgtagagtttggtcgaaatcggacgtcgtttggcgtgtttcggaccttaaaagctaatttggaagtttgaagtctaaaatggaaaaatatggattttcatggtttaatccgttgttttgatgttattttggcgatttgatcgctcgagtaagttcgtaagatgttaatgagttagtatgagtgtttggttgggagccccgagggctcgggagtattttcgggggtggttcggagagtttttggccttagccttgttgcagaaattgcagtctgttgtgcccaggtaattccttctatgcgatcgcgtacccttcctgcgatcgcatagtgttaaacttcagggtccttcatttgttcaatgcgaacgcacttggtccatgcgttcgcgtagtgtaaactcgaagcccccatctttgttctatgcgaacgcatcccttctccgtgttcgcatagtgtcttcctaaggagcccagaaaatactctatgcgaacgcaattgtctccatgcgaatgcactgcttcagccccctatccctatgcgattgcaatcccttctatgcgatcgcatagagcaaacccgtccagtgattttaaatagctccagaacagtgtgcatgggaattgtcttaactttcactcgaacttcttcttctccaaggctcccaggcgtccattgaagacccatttcacctagactttatgggttagtaaattcttactcatttcttccattttccatcaataatcattgaaatcctagctctaaaacatgaatcaaactagaatttagggggttttgggtttagttagggtttatggaattttgggcatttcaacctcaatttgaggtcgaatttaaaaactaattatatatttgaactcgtggggatatgggggattgggttttggtctgagcctcgagtttggaccatgtgggcccggggtcggattttggaatttttggaggaaagttagggatttcatttctaagctatgggttgttgtttttgagctattattgataagattgaatctaattatgcttagatatcgttgtttgggagttggattctaaaggaaaggcagttgtagagctttgaattgctagtttcagcatcgaggtaagtgtttgatctaactttggttcgagggattaggattaggatattgtttgttatgtgttatgtggtgtcggtgtataggtttggtgacggttacctatgcacccgagtcaagcatgaccgtgggtctttaattgatattgttcgacgctataacatggattcttgttgttgaattgattctcatgataaattgttgatgttgagtagataagatggcttatatgagaatttcaagtataataccttgccgaactatgtgtaactctgtgtagtctctcccttgtcaggatatttggttgatagctgcacccttgcttggtttagatgtatatatgtgatgtgattttccctaaaaggggccctgttgtaaatatatagaatttggcatatctattttgttgggatcgtgtggcgcaccgtccacttgaatatactattctaggatcgtgtggcacaccgtccacttgaatgtactattatgggatcgtgtggcacgccgtccacctgtgaaacatgatattgggatcgtgtggcgcgccgtccactattatacactaagcatgggatcgtgtggcgcgccgtccactatgtgctttctgttttaaataaagtatctgtagctttgtaatgtttagacttgtacatttctgtcttaaactgttttcccctatagcatgttccctcccccttgcctatttattctgtattattatttcctgcttttggtatatgtatatcttgcacaggttaacgctgtaggtcctgtctagcctcgtgactacctcgtgagccggggttaggccaggcacttaccagcacatggggtcggattgtgctgatactacacttctgtgccctttttgtgcacagatccgggagcagcctttggagcgcagcagcagtagatagggagccagccttcagtccagagactgctaggtagttcacttgcgttcgtgggtcctccccagtctcatcctattaagtagtttgtttatcatttcagacagactataactcttgtatgaagtaaatcttagaagtccgttgtgctgtgacactatgtttctgggtagaggatatcatatgcttgacttccgcatttcgttctatctttaatgaaatttgagacttttctttatgattaatcgctgtttccattcattatttgttgaagtaattagttggttattccttgtttggttggcttgcctagctccgacagtaggcgccatcgcgaccccgatagtgggaatttcgggtcgtgacaagttggtatcagagcactaggttacttgagtctcacagctcacggacaaactcggtagagtctgagggatcggtacggagacgtctgtacttgtttcccagaagctacagagttaggaaaatctcactttgttcattcttgtcgtgcgactctgtttctcaatattgattgtctctctactctgttccttcgtagatggagagaactcgagcttcctcttcttctgatcaacagcctgaggccccagtagcagctccagctaggggcagagggcgaggccgtgttagaggctgtggtaggggcaaagctcagccccgagcagcagcaccagtggtggagccccagattgacgttgaggaggttccagccccagctgtgcctatggttattccgggtcttcaggaggccctagctcagattatgtcggcttgctctggcctagcacaggtagtctcagccaccgctgcagtagccacctcacagacagggggaggcaatcagacccccgttatacgcacacctgagccagtagcgcagggatttcagactccagaggcaccgccggtgcagcaggttgccccagttcagcctgcggtgccagttcctccagttgtgccagttcagccagttgtgccagttccgtcagttgtgccagctcagcctatagtagcagcccagccagttgttgcgggccagtctagtgatggtgcggctatgtccgcggattctttgtggagacttgaccgctttaccaggcttttcactcatactttcagtagtacgccttctgaggatgctcagaactttctattcaactgtcatgaggtcttgaggaccatgggtattctggagaccaatggggtcgattttgctacttttcgcctggacggatccgccaagacttggtggagggattactgtctatctagaccagcagggtcgccagctttgacttgggatcagtttgcggagttgtttctggggaagtttctccccgttactcagagggatgctcttcgtcgtcagtttgagcgtcttcagcagggatctatgactgttactcagtatgagacttgcccgtcatgctattttgatacttcccactgagggcgagagagttaggagatttgttgatgggttgactccagagatccgagttcagatggctatgagtgccggtagtgatctctcatttcaggacgcggcggatggtgctcgccggattgagatggcactgtctttgggaggtggtttcgggtcagataagaggccccgttattctggtcgcttcagtggtacctcgtctgggggtaggggttcatatggtaggggccagcctccgagaccatttcagtcagctcttcaggcttctcatggtgccccaggtggtcgtggttctcagtcacagttttctgatcagcagctctacagctctccttcagcacccatcagtgcaacaccacttcggtatgctcagcagcctagagcttgtttcacttgtggcgatacgaggcacatcgccaagtattgcccccgagcttccagcagttcttagcagcagggaccccgtcccatgattcaggcaccacctgccccacagtctgcccagccagctagaggcgggggtagaggtcatagaggtggaggcagaggtcttaaaggtggagctcagccagctagaggtaggggccagacagcagcggatcatcctagagatgctattcagggagatggggcccagccccgttgttatactttgccagccaggctagaggctgagtcgtccgaagcagtgattacaggtactattctggtttgtgatagagatgcttcagtattatttgatcctggatccacgtattcctatgtgtcgtcatattttgcaccctatttggttatgcctagtgaggctttgggtattcctgttcatgtatctactctagtgggggattctatagtagtggatcgggttcatcgctcgtgtgttatggtgttcaggggtcttgagacccgtgtcgacttgttattgttggatatggtggatttcgacgtcattctaaggatggattggttgtctccttatcatgcgatcttggattgtcatgccaagaccgtgaccttggcgttgccggatatgccccgattagagtggagagggaccccaggtcataccactcgcagcgttatttcttatgtgaaggctcgacgcatggtcgagaaggggtgcctagcttatctagcttatgttcgcgactccagcgctgaggtcccgtctattgattccgttcctattgttcgggagttccctgaggtttttccttctgatttgctgggcatgccgcccgatagggacatcgatttctgtattgatttggcgccgggcactcatcccatttttatcccgccttatcgcatggcgccgccagagttgaaagagttgaaagaccagcttcaggatttgcttgagaaggatttcattagacccagtgtttcaccttggggtgctccagtgttattcgtgaagaagaaggatggttctatgagaatgtgtattgattaccggcagttgaacaaggtaacgattaagaacaagtatccactgccgaggatcgacgatttatttgatcagcttcagggttcgaaggtattttcaaagatagatttgagatctggttatcatcagctgaggattagggcgtctgatgtccctaagactgtttttcgtactcggtatgggcactacgagtttttggtcatgtcatttggattgactaatgccccagcagcattcatggagttgatgaatagagtattcaggccgtatctggatttgtttgtgattgtctttattgacgacattcttatatactcccgcagtcaggaggagcatgagcagcacctcagagtagttcttcatactctgaaggatagtcagttgtatgctaagttctcaaagtgcgagttttggttgagttcggtcatattcttgggttatgtcgtgtcagcagcaggtattcaggtagacccgaagaagatagaggcagtcaagaactggcctcgaccagcttcagctacagagattcggagcttcttggggttagctggttattacagacggttcgtagaggggttttcatccatagcatcccctatgacctgattgacccagaagggtgccttattcaggtggtcgaacgagtgtgaggcgagctttcagaagctcaagacagcattgaccacggcaccggtattagtgttgcctacaggttcaggaccgtacacggtctattgtgatgcttcccgtatcgggcttggtgcagtattgatgcaggatggcaaagtgattgcctatgcttcgaggcagttgaagatccacgagaagaattatgcaattcatgaccttgaggtggcagctattgttcatgccttaaagatttggaggcattacttatatggtgtgacgtgtgaggtttacaccgatcacaagagtcttcagtatctgttcaagcagaaggagttaaatatgaggcagagaagatggttagagttgctgaaggattatgatgttactattctatatcatccggggaaggccaatgtggtggccgatgcattgagtaggaagtcggctagcatgggtagtcttgcgtatattccagttggtcagaggtccttgccttggatgttcaatctttggccaatcgttttgttagattggatatttctgagcccagcagagtcttggcttgcacagttgcccgctcttctctatttgagcgtattcgtgagcttcagtttcatgatccccatttatgtcctgagagacacggttcagcgaggagttgccaagaaaatgactttgggaagtgatggggtgttgagattgcaggggcgagtttgtgtgcccaatgtcgatggtattcgagagttgatcttagcggaggcccacagttctcggtattctattcacccgggcaccgtgaagatgtatcaggatctgaaatagcatttttggtggcgtagaatgaagaaggatatagtagcttatgtcgctcggtgtttgaattatcagcgggttaagtatgagcatcaaagacccggtggtctatttcagaggattgagcttcccgagtggaagtgggagaggattaccatggattttgttactggtcttccgatgactcggaggcagtgtgattcagtttgggttgttgtggataggctgactaagtcagcgcacttcattccagttgctaccacttattcgtcccagagattagctgagatttacatcagagagattgttcgtcttcatggggtgcccatatctatcatttcggattgaggtccgcagtttacttcgcgtttctggaaagccttgcagggagagttgggcactcaggttcagatgagcacagcatttcatccacagacggacggtcagtccgagaggacgattcagattcttgaggatatgcttcgagcctgtgtcattgatttggaggctcgtgggaccagtttttgccattagtagagtttgcctacaacaacagttaccagtccagcattcagatggctccatatgaggcgttgtatggtagacgatgtaggtccccagtcggatggtttgagccgggggaggctcggttattgggtacggagatggttcaggaggccttagataaggtcaagatcattcaggatagactccgtacagctcagtctaggcagaagagttatacagaccgtaaggtcagagatgttgctttcatggttggtaagcgagtattgctccgtgtgtcgcctatgaagggcgtgatgaggtttgggaagaagggaaagctcagccctaggttcatcggtccattcgagattctggagcgagtgggagaggtggcctatagacttgctttgccgcccagtttatcagttgtgcatccagtgttccatgtgtctatgctccggaagtatcacggcgatccatcgcatgtgttagatttcagcactgtccagttggacaaggatctgtcatatgaggacgagccggtggctattctagaccggcaggtccgacagttgaggtcgaagagttttccttcaatgcgggttcagtggagaggtcagcctcctgaggcttcgacctaggagtccgagtccgatatgcgtagccgttatccccatctgtttcccgactcaggtacttccttcttttgtccgttcgaggacgaacggttgtcttagaggtggagattgtgacgacccaaagggtcatcaccataattctcctttgttccgtgcttctgaggcctcgaaaacctcttgaggggttgcctcgatttgcgtgcatagtctgggcgcgaagccgaaaagtttttatactgtgaaagttgaattatgtgttgaaaatgtgaaactttaagcataatattgatagggctgacttcggtcaacattttgggcaaacaggcccagacccgtggtccgtcaatttctgaaaatccgtagtaaaatatgggacctgggcgtatgcccggaatcgaattccgaggtcccagacccaagttatgaatttttcagtgaaattgatttctaaaatttattaaagatactgaaaatgaattttgattaaaaagctgtagtatcgggctcgtattttggttccgacgcccggtacaggtcttatatgttgtttaagcactatctgtagagtttggtcgaaatcggacgtcgtttggcgtgtttcggaccttaaaagctaatttggaagtttgaagtctaaaatgggaaaatatggattttcatggtttaatccgttgttttgatgttattttggcgatttgatcgctcgagtaagtttgtaggatgttaatgagttagtataagtgtttggttgggagccccgagggctcgggagtgttttcggaggtggttcggagagtttttgaccttagccttgttgcagaaattgcagtctgttgtgcccgggtaattccttctatgtgatcgcgtacccttcctgcgatcgcatagtgttaaacttcagggtccttcatttgttcaatgcgaatgcacttggtccatacgttcgcgtagtgtaaactcgaagcccgcagctttgttctatgcgaacgcatcccttctccgcgttcgcatagtgtcttcctcaggagcccagaaaatactctatgcgaacgcaattgtctccattcccgaacgcactgcttcagccccctatccctatgtgatcgcaatcccttctatgtgatcgcatagagcaaacccgtccagtgattttaaatagctccagaacagtgtgcacgggaattgtcttaactttcactcgaacttcttcttctccaaggctcccaagcatccattgaagccccatttcacctagacttcgtgggttagtaaattcttactcatttcttccattttccatcaataatcattgaaatcctagctctaaaacatgaatcaaactagaatttaggggtttttgggtttagttagggtttataaaattttgggcatttcaacctcaatttgaggtcgaatttaaaaactaattatatatttgaactcgtggggatatgggggattggtttttggtccgagcctcgagtttggaccatgtgggcccggggttggattttggaatttttggaggaaagttagggatttcatttctaagctatgggttgttgtttttgagctattattgataagattgaatctaattatgcttagatattgttgtttgggagttgaattctaaaggaaaggcggttgtagagctttgaattgctagtttcggcatcgaggtaagtgtttgatctaactttggttcgagggattaggattaggatattgtttgttatgtgttatgtggtgttggtgtataggtttggtgacggttacctatgcacccgagtcaagcatgaccgtgggtctttaattgatattgttcgacgctataacatggattcttgttgttgaattgattctcatgataaattgttgatgttgagtagataagatggcttatatgagaatttcaagtataataccttgccgaactatgtgtaactctgtgtagtctctcccttgtcaggatatttggttgataatagcacccttgctgggtttagatgtatatatgtgatgtgattttccctaaaaggaaccctgttgtaaatatatagaatttggcatatctattctgttgggatcgtgtggcgcgccgtccacttgaatatactattctgggatcgtgtggcacgccgtccacttgaatgtattgttatgggatcgtgtggcacgtcgtccacctataaaacatgatattgggatcgtgtggcgcgccgtccactattatacactaaacatgggatcgtgtggcgcgccgtccactatgtgttttctgttttaaataaagtatccgtagctttgtaatgtttagacttgtacatttctgtcttaaactgttttcccctatagcatgttccctcccccttggctatttattctgtattattatttcctgcttttggtatatgtatatcttgcacaggttaacgctgtaggtcctgtctagcctcgtcactacctcgtgagccggggttaggccaggcacttaccagcacatggggtcggattgtgctgatactacacttctgtgccctttttgtgcatagatccgggagcagcctttggagcgcagcagcagtagatagggagccagccttcagtccagagactgctaggtaattcacttgcgttcgtgggccctccccagtctcatcctattatgtagtttgtttatcatttcagacagactattatgtatttctttcttcaaactcttgtatgtagtaaatcttagaagtccgttgtgttgtgacactatgtttctgggtagaggatatcatatgcttgacttccgaatttcgttctatctttaatgaaatttgagacttttctttatgattaatcgctgttttcattcattatttgttgaagtaattagttggttattccttgtttggttggcttgcctagctccgacagtaggcgccatcgcgaccccgatagtgggaatttcgggtcgtgacagcgtaggggggaagaagccacaacaatgcgatcgcgtggacgaagcagcgatcgcgtagaaggaaacccctgtgcaaaaattgcagaaaatctgccaagtttcaaacaccaaaaacaccccgaaccaccctcgaaaacactcccgatcccccggggctcccaaccaatcatacacactaactcataaacatcctacgaactcactcgagcgatcaaatcgccaaaacaacatcacaatcaatgaatcaaaccctaaaattcattattttccattttagacttcaaacttcaaacttagttttataggtccgaaatacgccaaacgacgttcgatttcgtccaaactttacagatagcgcttaaacatagtataagacctgtaccgggtatcggaaccaaaatacgagcccgataccttagttttttttatcaatattcatttccattatctttaattaatttcagaaatcaatttcacagaaaaattcatatcttgggcctgggacctcggaattcgattccgggcatacgcccaagtcccatattttcctacggattttccgagaccgtcagatcacgggtccgggtccgtttgcccgaaatgttgaccaaagtcaaccatatcaatattataatcaaatttcatcaaatttaacacagaattctaatttcttaacgtaaaaactttccggcttcgcgcccgaaatgcgcacacaaatcgaggcaatcccacaagaggtttttgagacctcgaaagcacggaaaaggaaggatttacggtgatgaacctttgggtcttcacattccctttccgagctaaatttcgaaaattaggggaaatgggttagggattttaccttagaaagcagtggagaagacaatgcaccaagaattttccaagctctaatgattttgaaaggctagatgatgatgagatgactttctctctcaagaaccctctctccctctctcttaatttgttcagaaatatgttaaaaatgagggaggaggtgtttttataaaagatgggtcggtttataaatgtcagaaaaataccaggcgagctcgatctgcgacgcgatctgcgatcgcagatctgacatgcggtccgcagaatggaccgcagaaaggggctcaagtttcggaacttctctggaaatttctgcggccggaatgcggtccgcataaccgttttgcggtcgcagaatgcaccgcagaactgaccctcaaatttcttcaaagattttatgcggtccgcatatcaattatgcgatcgtagatatgaccgcattttcaacatcaaattttgacaactctcgggaagtttctgcggcagaaatgcggtccgcatagctgatctgcgaccgcattcttgaccgcagatttgcctatttctggaaaaaatttgactccaactttcaaagtgcaaaacagtaaaagaatttcacccacgaaggtagacttgactctatgagctgcctggattcgagcacccattttcatggggccttacacatccgcatagtcccatccttcttcttcacaaataacattggtgcaccccaaggcgatatgttgggcctaacaaaacccctttgccaacaactcctcaagctgctccttcaactccttcaactccttcaactcttaggagtcatacggtacggtggaatagatataggttgggtgcctggagccaaatcaatacagaaatcaatatcacgatccggtggcatgctagaaagatcagaaggaaacacatcggcgaactcccgaactactggaactgaatcaatccgatgtctcgaacataagctagatatgtcaaacaccccttctcgaccatatgtcgagccttcaagaaagaaataacccgactaggtgtatcaactgtggaacccttccactccaaacataataataaaattgatcataatttttaagaatatacaatgtgtattataaaaatacctttatttaaatgattatttttaaattacgtacatggaatatatattttacaacctttattttcgttcattctgaattgtgtaaataaattttttattttttgttgtaaatactaaaattattattactaacaagttattctaattaatttttttactatgctcagtaatttgttattctagcattatatatgcttaaatactttttatttttttaatttataaataatatttatttattctataggtaaatccataatataaattaaaaagaaaaaaagtcataatagtaaaaagtttaaagaagatgaatgtttataatttagagggtaaaataggtatatggcaacctaaaatttggaaaatctagtttagttactttttgactgcaataggcatagattagtgactttgttattacaaacgaaagaaaagtaactttagaagataatttgagatagttgagtgaccatttgaataataaactctaggaataagttagatttttaatgttgttatatcctttttcaatatttatctttcacattgttatcctggagatgaaacatcatttgcttttgcatatatagacctgcgttgaagtatctgcattacttgttcaagatttttaagtttcagttatttcaagttagtattacattattcctatcccgaccacaacagggcgatttcacaagattcaaagttggccatacatacctggggttgaatgtctcttctaacttctagtccaattcaccaagcaattcaagaaatcaatctagtttcatgatcaatacacaaaggtcttagaattaagctcatagttactacccaattcccattttagctagattctagggctttaaggtcatgcatgaaggttccattaagaattttaaagataaatgcatggggttccctttccaagctaaatttcaaaaattaggggaaatgggttagggattttgccttagaaagcagtggagaagacaatgcaccaagaatttttcaagctccaatgattttgaaaggctagatgatgatgagatgactttctctctcaagctctcttaatttgatcagaaatatgttaaaaatgagggaggaggtgtttttataaaagatgggtcgggtttaaaatgtcagaaaaataccaggcgagctcgatctgcgacgcgatctgcgatagcagatctgacatgcggtccgcagaaaggggctcaagtttcggaacttctctggaaatttctgcggccggaatgcggtccgcataaccgttctgcggtcgcagaatgcaccgcagaactgaccctcaaatttcttcaaagattttatgcggtccgcatatcaattatgcgatcgcagatatgaccgcattttcaacatcaaattttgacaactctcagaaagtttctgcggcagaaatgcggtccgcatagctgatctgcgaccgcattcttgaccgcagatttgcctatttctggaaaaattttgactccaactttcaaagtgcaaaacagtaaaagaattcgacccacgaaggtagacttgactctatgagctgcccggattcgagcacccattttcatggggccttacccatccgcatagtctcatccttcttcttcacaaataacactggtgcaccccaaggcgatatgttgggcctaacaaaacccctttgccaacaactcctcaagctgctccttcaactccttcaactcttaggagccatacggtacggtggaatagatataggttgggtgcctggagccaaatcaatacagaaatcaatatcacgatccggtggcatgccagaaagatcagaaggaaacacatcggcgaactcctgaactactggaactgaatcaatcgtcggagactctatggtgatgtctcgaacataagctagatatgccaaacaccccttctcgaccatatgtcgagccttcaggaaagaaataacccgactaggtgtatcaactgtggaacccttccactccaaacataataataaaattgatcataatttttaagaatatacaatgtgtattataaaaatatttttatttaaataattatttttaaattacgtacatggaatatatattttacaacctttattttcgttcattctgaattgtgtaaataaattttcgattttttgttgtaaatactaaaattattattactaacaagttattctaattaatttttttactatgctcagtaatttgttattctagcattatatatgcttaaatactttttatttttttaatttataaataatatttatttattctataggtaaatccataatataaattaaaaaggaaaaaaagtcataatagtaaaaagtttaaagaagatgaatgtttataatttagagagtaaaataggtatatggcaacctaaaatttgaaaaatctagtttagtgactttttgactgcaataggcatagatcagtgactttgttgttacaaacgaaagaaaagtaactttagaagataatttgagatagttgagtgaccatttgaataataaactctaggaataagttagatttttaatgttgttatatcctttttcaatatttatctttcacattgttatcctggagatgaaacatcatttgcttttgcatatatagacctgcgatgaagtatctgcattacttgttcaggatttttaagtttcagttatttcaagttagtattacattattcctatccagaccaaaatattcctatacatttaataaaaaattttaatataaatatatgatctttaacaaaagttacttaatacgtaaacgtgtaactattacaccaaatctggcccttttggacttgttgccctaagatgatacctcacaagaaacaaattagaaaacggaaaagggccaaatacccccctgaactttacgaaaagggtcaaatataaccctcgttaaaaatttggcccatccacaaccctaacgttacattaatggcccatataaccccctcgtttttaacggcgacaaatacccccctgaactttacgaaaagggccaaatataaccctcgtctttttacaaaatattttttttgtttgtaaaaatatatttgtaaaaactgaaaatattttgttaaaaatgatttctttaattcttaaaaaacgaaaatattttgtaagaaaatgaatttttcccctatttttacaaaaaaaaaaaaaaacagtttttataaaatttgtttttccagtttttacaaaatacatctttaaaaaactgaaaaatgaagaaaaaaaatatttttcaaaagagaaaataatttgttgaaaatatgttattcagatgattaactcacaaaaagaaatacagacacaaaattacaattgcctacgcttcgtgatagaagaatattattattccatcaaagagaccagttttaagtacctaaagtatctttatgatcaaaatattatattcaaaaattttgatgttttttttcaatgtacatatgaatattttcaacaaattattttcgcttttgaaaaatatgttttttcttcatttttcaatttttcaaagatgtattttgtaaaaactggaaaagcaaattttgtaaaaactgttttttttttttttttttttnnnnnnnnnnnnnnnnnnnnnnnnnnnnnnnnnnnnnnnnnnnnnnnnnnnnnnnnnnnnnnnnnnnnnntttttgtaaagacagggggaaaaattcatttttttacaaaatattttcgttttttaagaactaaagaaatcatttttaacaaaatattttcagtttttacaaatatatttttacaaacaaaaaaatattttgtaaaaaacgaaggttatatttggcccttttcgtaaagttcaggggggtatttgtcgccgttaaaaacgagggggttatatgggccattaatgtaacgttagggttgtggatgggccaaacttttaacgagggttatatttggcccttttcgtaaagtttaggggggtatttggcccttttccgataagaaaacaaattcttataatcgtgttccataaatgtgataaaaaatatagtataacgattacggagtagtctcatgaagcaagttaaaatagcatggtctagccagttttcggattggtcatttaaaaatattcagcgtttgccaagtcattaaaaaatagccactattttgctgcaacagagaccggtccagcataatatactggagttcgctgcatctgtgtatgaacttccagcatattatgctggacctttatactttgctggctccagtataatatactggagactggagcaccggtgctccaaactccagtatattatgctggatcagtatattatactgaaacttcggtatattatgctggagtattttttcagattttaaataatgttttcgtttagatttatctttacataaaaagtgactaaatttcgattacttttgaaattatggctatttttgaatgatcatttataaatttgtctatttttgaatttctcccctgaagcatggtaacgataatatatgatagaacaatggtattttccagcattaagtaatgcaaatttattggtaaaaaggtactaagaaaatattttgtagtattgctcaaacgttatagtgccttgaaaatgtgttaaacatttcctaacacatgatctctctctttatctccaaatagtttaaagggcaaagttgagcttctattttaacagcactaggtcaatattgcacaaaaaacctaacgaagggtacttttgttatatttctagtagtttaagggacaaaattgagcaactattttaacagcattggctcaatattgcactaaaaaccaaaattcaagggtgcttttgctatatttgaataatttaaggggtgaaattgagccaatattttaacagcaatgcgtcaatattacaccaaaaaccaaatgaagggtacttttttctacatttcctatagtttaagggttaaaaaagagctactattttaatagcactgggtcaatattgcaccaaaaaccaaacaagggtacttttgctatatttccaaaagtttaaggggcaaaattgagccactattttaacatcaccaggtcaatactgcaccgaaaacaaaaagaagggtacctgcaccgaaaacaaaaagaagggtactttgctatatttccaatagtttaaggggcaaaatggagcaactatttttacagaactgggtcactattgcaccaaaaatcaaagagagggtacttttgctatattataaatactccatccggtccaaaataagtaattttttgattttttttcttcttgtgatccaaaataagtgattttttcagatttcaaaaatgaattaattaatttttttcctacattgcgcttggagtaaataatgttggagtatgtgttaggagtgtttatgtgaagagatagtaaaggttaataggtcaatttcataactaattaatgttaaaaggtaaatttcttaatatgtgtaaaaacaactaaagttttacttattttggaccgagggagtagtttaagcggcaaaattgagcaactattttaacagcaataggtcaatattgcaacaaaagccaaactaagggtacttttgttctatttccagtaatgtaggtatatttttcaaaaaaagggtgtaaataatcgtatacttttaatacgacgtactgtttcgttttctctttttctttttcgtttctttttctgctaatttctctctctctctctctctctctctctctctctctcatacacacacacacacaggcaggcattctggttctttctcttttccctgtttgaagatcgcaatttggatcttttttgtcaaggtaattgtatatgtagtttagaatctatttctgttttttactttctgtataaatggaaaataaatcagagttttgcagtttgtatacttttttttttttttttttttttttttaattttcagattgtcgaagcaaatattcagtttttaaaccctaaatgaatataaatttaaaaaaataaaaatccaacctttggttacaggtttttgcaatttgtttagtaaagcttaaaacttggtggcctgctgagtcttgcaatttattttttattttaccccttgctgattttatgtggatttaccatttttaaagaactgaggattcatatcgccgaacacaactttgtttgagattgtagtgaaagtatcatttgtgtattgacccgcccattttagcccaagtaaatttgacccgttcatttgtgtactatctaatccgtctatttgacacccctaggtgtaagttaaaagcggttgagatatgtatatatgtgatataaaaggaaaataagaaaagggactgttctcacttatatgccaatgattaaagagatatataagtctttgaaaatggtagtatttgaatactttggcttattcgagttttacatgtgtatgatgatatgagttgaacttaaataacgtagtcaagattcatataaccgattctaacttgtatgatgatatgagttgaacttaaatgacgtagtcaggattcatataaccgattctaacttgtttgggactaaggtatagtagttattgctgttgtattcaatttttacatgtgaattgagtgacatatcgtctgttccgtactacaaaaaagggaaaaattatgtggaatcactgatagactatgaatgtgaaagtcatgatctatgttgctcagactctgcgaaaatatcatcgggtgcgtgttggatcctccaaaagtagtgcatttttggaggatttgatacgggtgcggaaacattttggaaagtccgcacaacataggtcatgatattcctagttgagggtggtgttgcgctaatatgtgagtaacctgcagaactaggtggaaagatgcaattttaaatgtgttccaggatagctagtgcagtttatattctcacatacacatccagattctgataattgtctcttaacaaagttcactggcaccacattttatattaacgtgttgagtcaattgtttcaggccagcaatgcaatgtttgaatgcagatgattgatcatacagacacatcttttagtacttactaaccagctgaaaccatgaccattaggattatcagattctttgtcacgtcattttccaatcccgctactctaattccaaatccaagtctccgctattttcgcactaacccaacagttgcaaaacagatatcccaaattcaatatcctctacaattccaagaaagctccccccaaagaaatctcatcgcggtgtctagtcttcttaaaagatatggttttccagctctagaacttccaaattttctcgagaagaatcgtcgtttactgaatctagaccccaccaaaattaaaaagtctcttaagattctattatccttgaaaccatctcaagaattccttgtgtccgtgataaatagttgccccagggttctagaatatgatgctatcaagaaatgggaaggaggcatccgaggattagaagaggggtccaatttatcctccttagcaattcggaatattctggaggtctcggtgaagtttgaactagattatagttgtgttttggggtctctgaaatgcctcaaggatttaggggttagtgatattactctaaataaggttttggagacacatcccatggtaactacgatgtctgcagacaagattcatgactgttttgaattcgtcgttgatgcctttaggattgacaaggttggatttgatcgccttctctgcgtgtatccaggtgttttggcctttgggattcaaagtaagtttaagcgattgcttgatgaatttaaagttctgggttttaacatggaggtggttaagaaacatgtactgagagatcctagaattcttgcgttggaacttggggagttatcgcgatgtttggagctgcttaagagtttgaaatgtagggaatctattaaggaggatatttttcatgagggggcttttaaggctggatacgaggtgaaactaagggttgattgcttacgcaatcatggattaaccttaagggatgcttattctgtgttatggagagagccgagagtgatactttatcgcgtagaggatgttgagaagaagattcagtttttagtccacgtgatgaaagttgatattcagtgtcttgttgaagttccagagtacctgggggtgaatttcgagaaacatatactaccaagattcaaggtaattgaccatttaagagcaataggaggacttggcgatgaggtgggattgagggagttgattaaacctagtagaatgaaattttataatctatattgcaagccttatccagagtgtgaagcaatatatggaagatttgcaaaaaatgctgaagtgagaagtcaacatccagtgggaatgtggaagcttttcaaaccacaaaataatccaaagtccaaagaaaatattatgaacattaagtcgtatatggattcattggcttgagttctggatccttcctctaaattctacccgaaaatgcatctatgtagcattctcttggaagatccttttctgaggtatgtttctcatccttattcgtatgcttttccttaatgccactgtagtgtgatgttctgtttcgtagttgcaatttttgtacaatccctttcgttttataaatttctttgtaattttttttaaagatgaagtaagtaacattgataaggcgtcaagaagatgcagatttgctgggaggtaaataggagcatttttttagctggctatgtgcctcttttggctcctgtataatactgccactaacatcatcagatcaacctgcgcaggctcgtttatatcctctctttcagaattagaaccgaatacaaaaccgctgttctttgtttccaaagtttttagttctgtagtcttaaaaacttggaattttgataggcctatatacttgtcatatccatcatttggttccaagtttaagtggagtatatcaatctttcaattctcttgcaaaataatttttaaggaggtgagtggtttttacatcaaatatagaacatacccacatactactcgttacaactcattttagcatcagcaagggttgtgtttttatgttttttttctagctatactcctttttcaactggtacttgtaacattttccatttccacatttaattattcttgccacaaaaggatttattttattttttttaaaagggacaagtactttattcgcaaggattagcggtgaaaagttaactgctcttgtccattaaaaggattagaagtgctttctcattcaattattagttttttcttcttgtttatcaatatttgttcttcttctcgctcgtcccagtctctgccgcagctgaaagagggatcaagatgtgcatgatataatgtctgcttgttttggctgggtgaatatcagttgaacatcaagctggaagatggggatggtgctgagatcaaattctggggtgataattggctgcattcagagaaacttaaagttaacttccccgttctttatagcaccacagtgaacaagaattgctgtgtcgctaattgttacaatgaaacagggtggcagctatagttcagcaggaatttaaacgattgggaaatttcaacgatagaagactaaagcacaaaaagaagttgtttgtgttggatgggtggcttcaagaaatgcatacttaacacaagattttcttcagaagagaggctttgtaaagtgcagctgatgtttcttgtgtgaaaaggctgtagagtcaaccgatccatctattacttcattgtgaattttcttggcaggtttgatcagtaattttatgtctgtttggggtgcaatggtcatgccaatgtacaaggtctactcttaagctatgttgctcggactctccaaaagtgttagccgcacccgtgtcggatcctccaaaaatgcactaaatttggaggattcgacacgcacccaacaacatatttgaagagtctgagtaacatagctcttaagttggcaagcacagttggctgggaatatgaaaagatttggagaacagcccctatatgcattatgtggaacatttggctagagataaatagaagatgttctgatgagagcataggattcatctgtggtgttataataaatactaggatttacttaatgtaaatacattgttttcttcattgtgtttattacatacagtatattgtttaaattttagaattgagacacagtagaatgctgtatgtataatgttaacttaaacatagtgttatatatgtatttctgcacctgttgtacatgagttgccgcaatccacaagtggggtctggagagggtagtgactacgcagactttatccctacccctaccccgagggagtagtataaacaaaaacattaaaagtggtttaaaacaatagataacataacagagaaataaaatgtgatgtagagaaaataagtctggagattattatgtaatgtagagcataatgagaggtctcaacctttagcaaattgaagattaacaaaacagtagcaaattctggaaataaagaagaagtgcagaaaaagaatcaagtttaacatgggtagcaatgtaacaagaaactgcatgagttcatgttatcatgtctattaacacaaatcgcagcgggcagctcgtaggtcctttaggttttgagaactatatctgaaaaatgtgattccataagtgttgttttgtacatcttcttgaagtactgttctgtacaattcctggacaacttgaaataatgaactatgtgagcttctcccgttaactttatatattgcggtttacatgttttgcagtaatcctggagctcttagatacgactcatggtacacgttctaggacccgttgcaaagcccttttaattccttcttgatcaagtgatgtcgtcagttgtatttcttgcacctgatcgttaacaattattttagatttgcaaaaggcagcgtgggtcgttggaagggggaaagcgtgaggtgaaagatgatacctgtcttccagcccgagcaagtagagtaaactgatctccagaagctggtgcctgtcggatgccataacagaaacgattggaaatctattatgcataaatactgtgagtcacatatggtttatgtttgacacaacttacattcgacaaccaaagctgtaaatcctgtgaaacgactcgcttctcaaatccttgtcgagtaattgtcacatcatatatgctattgaacaaaaacacacaactttgtcagatttgcttcaataatcaagtgaattaaccagaaaactgtcgtgtataattattcgatgtgctaaattagtgcagataatggtatatatacaaggaagcgaacgaatgaagaatcaaaatacaggccaatttaatcaaagagatgtttttaacgaagcttcctgagagttactcctacgggataagagatatacatctatgattgtttcgagaaatgatgaagccatagtgttcaagttctaaacatcagatccgatgttaccaaatgatcgtttatatcaagtcctcgtccaacttagaccaccaggctttgtttatagtggtaatgtcaagggaccatatcgtagtcataatgagaagtggtatcgtttacggattaatcttcaattttcatgacatgccacgagcacttacaaggattcacgtcgtagcaatggaggtgaagttttctattttatctctaggtctctaaattttattctcaaatgatgaattaatcagctcataacctcactacggaagatggacaagtacttaccaagacattcaagtacgaaaggagacaattcataatagatttacaacgacgacccagtgaaatcccattagtggggtctggggaggatagtgtgtacgcagaccttacccctatcccgaaggagtagagagactgttccgaaagaccctcggctcaagaagacaaaaagacaaaaggggacaattcataatggatttgcgagcagaaaaccgttcaagcaaataggtctaataaaatcttcatataatagcctaatgaaagacttaatgccaagaattaaacttcaatcatacccatcttcttgcattagttcttcaattattgtttcaagccctggaagaggctcaataacaaagttgccatccgaatccaaggaattagtgtcgacggatgcttcctgcaaagtgttgtaattcatcagtaacagtattacgcagctagagaaaagatttcaagaaggaggcgaggccaaaattctatcatttgcacatctcaccttgtgaattactttgtccagagtttccagcaatggatcttcctccaactgtttaattgacaaagtaatcctagatttgtctctgcaatgtgttcgtgtattgtgaaattgaaagagaccgcgcgaaaaaaataaaagaattaaaaacaatcactgccttctaattcaatcatatggcagacgcggtagacatctcagcctatcaagttctatctcagcaggcgatactgtttaaagaaaacgtttgctagcagtaccagacgacagatctacgtaagcatgatcatgagaaaatacctgtctatatttataattttgaccctcacatcgtcaccttctgtaaggatatctctcacatcatgcactaaatcccacgacacttctgagacgtggacaagcccagtaaggtgatatgttcctgcatcacatggtaaattcgaagattgacataagtaccggaatagtcaggcttaaaacgtatccagactgacaagtctgtctcttatgaaaaagtaccatctgggaagcgcagatgaacaaaagcaccataatcctcgactgaaccgaccctcgcttggaaaatgtcacctacattaatttgattagaaaacttcgaccagctagcatccttttcagagaaaatcaaccttcttttgtcctcatcagcttggattacctaacagcagcctaaatgttaactgatatttgaatcgtaaaggaaagtcaagacgaagaaaattaactccaagtacataaaactatatccttaaattactaagcaagactaatagaacgataaaaataggttgttgggatcaaaacggattatgtggtcaatgaacggatccagaaagagcaaaagaatcatggcgcagtaagtttacatcatacttggaacttggcttacaagtagctatccgacgtgagattcacgaaaaggaaatcttagcttctcggaattttgcaacattctgcaaagcttaagcactagaaattataatgtggcatctaaaatttaagttccaaatcttcaagatgcattataagttcaaaccaagggatactttacaagggcaatgtgcatgctttagatgagaagaagttcaagaatagtatctaagtgattaatatcggtaccttcacggagaggacagaaccggtcaagtctcttgcgatctcttgaatggtcttttgtggttctacaaagtaatggaaataagtaagataaacaaaactttaggaattaaatatcttgtcaatctcgactagaagataatatgttctcctaacgattgtaactccatcgaaacaatacaaactatgaaaaaataaaaaaaataaaaactaacgcaaacatctatcatctctgcttatgattcccttcaaaatgacatacaattgcagatggcaaacatttttaaaatgatgatcaagcacaatataagctaaaaagcgttgaagttagtacctttacaagagtaataagggctcatctgcggaaagggtagaaaacccacaagagaataaaatcgaatcaacaaaccaccaccattgaagccttcaaccttgccctcgaatatatgtcccttctcacggtatgtctttgccgctttccaatcagcagacttctaattctttgtagtaaaggagaactacattacatacacttcaaaccacaataatcttacggaagcataaaacaaggtaatcaaaaacattgaatcaagtcaatcaacagatgaaaagaccagccgtgtaagacatatggtactgtggccataatcatgtcctaaacaacactacttggataactcaacggcgtaatcaatagaactttatctgaaccattattattcaaaaaaatgccttagattcgaaatgctcgagttttaactagttaactccaattcttcttaactctatatcggcttatccaatcatggtccaacatcaatttacttcctccattcagctatgcttatgagtctgctgccattttcacagttcattagatactttatcaataacaaagtaaactgtaaactcctcaaacattttttagtgataaaacataattaaccatccactccgggcgacaaaatgctatcgcttatatgagcatcaccgtcgagaaaataattaaaaattaaatgtaagtgccctttaacaaatgaactaccaaaatgaaatggggttgcttcatttttttttcatcctaagttccaagacttcacttacaaaattcttttcaatttcaagattcttaatttccttttttttatcagccaagaaaaagacttaaaagcaacaacaacaactactacgactcagtcctaaacaagttagggtcgactacgtgaatctcacttctccatttaagctcaactcatgtaatcatcacaccaaataaaataaaagtgaaagtacaataacacaacaatccagtataatcccacgagtggggtccaggtagaatagtatgtacacaaagcttacccacaacccttaccctgtgggtagagagtgtgtttccgaaagaccctcagcacaagaagaaaaataaaagtgaaagtagatgagttaaatatgaataaagggtcttccggaaacaacttctctaccttctttaggtaggggcaaggtctgcgtacaatccaccccggactcctaagttccaagacttcactttcaaaatccttttcaatttcaagattcttaaattttctcaattttcttatcagccaagaaaaaggcccagaagcaacaacaacaacaactacgtcttagttccaaacaggttgggatcgactatatgaatcagcggcagacctagtgcatggactacaggttctcgggaacccagtaacttttgcgtagactctgtatttatattaagaaattcattaaatattaaatatctgactgtgaactcagttattattgcatattaatttgaaattacggtaggaactcataagcttcaaatactcataagcttcaaatactggatccgcctctcatataaatcctcactccttcagctcagctcatgtcattgtcataccaaataaattaaaagtgaaaatactgagttaaatatgaataaagggtctcacccgatcttgtttgatctcatcaggggccaaagattgttgatcaactccatcaattttagcattactagtagaaactgaaactctaggacttaacaaacaaccccttttgagcaaacaactactaagtgaaaaattcacatgtaatgggcttgaattagctgaaaaacaacaagaatattgagtggaaacagaatcactagtaaaaaactgtgaaagaactgtggctgctgtaaaagcaggcattatattactatgcctttatatgaaaaatcaagaattgagcactagagtaaaagagggaagtttgagagtgtggaattgaagttagttatgtaattttggaagttttttccatggttttgagtgagtggatttggtttagattgacgtgtgaagaaggagaacacatttgttctaagatgttttggatcatccatgtgtcatcttgtaggtccttttgtgggcccataatctatcttttcctaattttggataatttattgtcaatcacttgttgagaaattaaacatactaatatatatttagagctcttttggacatgaaattttttttttcgcaaaattttttacttttttggaagtcaggctctggccataaatttcaaattttcatttgaagatgaattttaaaattttttgaaaatttagaaaactcccaaaagttaatttttcaaaattttcactcatatcactcacaaaacttcaaaaataactcaaaattatattcatatccaaacacaagtctaatttcaaatatatatttttttggtaaataaaagatattattacgaaaggcagtaacagtaagtacaaatagcaaggaaaatctagggatgagttctcactccaaaaataaaaaataaaaaaaaagaataagcaactataacaaccaatcttccctaattactctccacaaactaagctattaaggataaaaattcaacttatcgagttctttaattagtctgctcctttgtgaccctcggtagaatacttgttgctaacaatgctacttttgccaagaaatcatgatggtctgccaggtgatttaagaacttatttttactttattttttttgaaattttacaattcttatgtccaaacgcccacttaaattaaacgtcaaagtatatttaaacataaaaaaaacttactagtactcatatatataaaaaattaataaattgataattcattttttcttgaaatattaaaaagtagtagttttaaaatttattgtgaagcgattaaaattgaaatagaagagccttaatttattgtaaagcgattaaaatttaaaatagaagaacaataaacattattgttaaggacgtggatgacgatattcctccacctttaattagaagaatggatcttcttattcaaataaaacacattttgtagcctataggttagtcttatgactctttttctactcctcttgttttaaacttttagtggtcctttgattagcaacaaagttatccaaatattataatttcaggattatatctaatttggaataaatattagtattaaatttaagcataaaatttataccaatattaactcataaactaataatcaatcactagagaaatgtaatcccaaattttatattaaaactagtattctaatcccggtaattaaatgggaagatgttcatactcacaactatcaatttcataagtgtaccaaaaaactccaagaaattatattatcaataaaattgagtatgaagttctaaaatgtcttgaaatgagcatgtgcatataaaatgggtaataattgtcttatttaatctcggaaaggggaaaaaataaaacattattgggtaaaagatagtttgtttttttgttgctcatccgattcatattggggctcaactaaatttaaattcgtgccaaagaattttatattagaagataaagtgcttcttaataaaggtgattacatactcaatattaaaatatgagacgtctgattaaggatgaaaagaatttaccactatactagaacccttgttggcacggtaaaagacggctattagagttgttcaaaatcgaatcgaaacagttaactgaatcgatagcttattggcttattggtatcggattatcgggataatgaatggtgaacagattaaaaaaaatttaattaatgacttaacggtttgggtgtggattactcaattttcttgtcggataagccgttaatcagttaagaattttataattacactttcctataaatattgaagtagcaagaactcgtaagactcgatgtccattcaatttataactttcccaccggaattttcaattttatacagctcatcaggtctattaggatgcgtataggaagtcagtcaacaaaatcacccctaaaaaagaatccatttgaatgttacacaattttttttttggtttagccgataaattaccatcattaattcgatatcaattcatctgttgtcttattaaataattaataaattattatatttataatctaataactaactaaaccgttaaatataattatccgtctgattcacccggtaagcacccctaatggctatgcagcaacaaagtaagttcaaaagaaagtacaaaaaggtgaatttggatatcataaatgtatggatgtggcttggagttgataaaggaaaaggtagtgtggttcgccttttaagttattgatgatgtctttgttttgcgcgcgtgtttgaaacggcacgcttccaattatagttcgttatttcgtccattttatgtgtttaattcattggacacgaaattaatactctgttttttcatgtaaaggtaaatgattggatacaacagtgataataataataataataataataataataataataataataataataataataatactgaaaagagggaacaaatgctctaactctgagctgagggtctatcggaaacaacctctttgccctatcaggataggggtaaggtccgtatatacattagcctccccggaccccactatgtagaattttactggataattattgttgttgttattggaatagatgctctaaactagaacaatctcctcccacagaaaagagagaaattgctcgactgactattgactttctatcctaatgctcgccttcattgtctcctattaatggtcatgccttcggtgagttgaagatgtgtcatgttatgtctaatcacctatttctagttctttttcggctacctctatcactccttagacctcacctgctaaccactcacattatctcactagggcatttatgtttttgcttttcacatcgccgaaccaccccaaccttgcttccctcgtcttgtctatcacagaggccactccaaccttgccgcgtatgtgacgacccaaagggtcatcaccataagtctcctttgttccgtgcttctgaggcctcgaaaaacctcttgaggggttgcctcgatttgcgtgcgcagtccgggcgcgaagccggaaagtttttacaatgtgaaagttggattgtttgttgaaaatgtgaaattttaagtataatattgatagggttgacttcggtcaatattttgagcaaacgggcccggacccgtgttccgtcaatttttgaaaattcgtagtaaaatatgggacttgggcgtatgcccggaatcgaattccgaggtcccaggcccaagatatgaatttttctttgaaattgaattctaaaatttattaaagataatgaaaataaattttgattaaaaagctgaagtatcgggctcgtagtttggttccgacgcccggtacaggtcttatatgatgtttaagcgctatctgtagagcttggtcgaaatcggacgtcgtttggcgtgtttcggaccttaaaagttaattttgaagtttgaagtttaaagttggaaaatatggattttatggtttaattcgttgtatttgatgttatttaggcgatttgatcgctcgagtaagttcgtagagtgttaatgagttagtgtgtgtgattggtttggagccccgaaggctcaggggtgttttggaggtggttcggggtatttcggacttaggaaaatgcatcagaagttctgcaattttatcacagaaggtttgttcttcgcgaccgcagccattactcgcgttggtgatgcccagcgtgtccctctctttcgcgatcgtggatgcctttcgcgttcgcgtaggcttcccaggaccccctgcccttttccctttcgcgatcgcgtggtctgtacgcgttcgcgtagaccaacttctgaagccctgatttccttatacgcgttcgcatcatctcatcgcgaacgcgatgcttcctcagcccttgtgcttcgcgaacgcatcctttagtcgcgaacgcgatgaagtattttgcccagtgaaatattttaattccagcactgttcatccgcgaccctcacttcatttttcactcgaaccctcttctaaaaactcccattgacggaaaaccaagctttcaatcttcctaattctttgggtaagtcaattctaacttcatttcttcaatatttcttcatcaatcattgaatttcctaactctaaaacatgaatttaagctagaaattaagggttttgggtttagttagggtttatgggattttgggtatttcaacctcaatttgaggtcgaatttaaaaattaattatatatttgaactcgtggggatatggaggattgggttttggtccgagcctcgagtttggaccatgtgggcccggggtcgaattttggaatttttgaaagaaagctaggaaatgcatttctaggttatgggattgtgttattgggttgatattgatgattttgaatctaattatgcttagatatcgttgtttgggagttgaattctaaaggaaaggcggttgtagagcattgaattgctagtttcggcatcgaggtaagtgtttgttctaactttggttcgagggattaggattaggatattgattgttatgtgttatgtggtgtcggtgtataggtttggtgacggttacctatgcacccgagtcaagcatgaccgtgggtctttaattgatattgctcgatgctataatatggaacatgctataacatggaatcttgttgttgaattgattctcataataaattgttgaatttgagtagacaagatagcttaaatgaggatttcaagtataaatactttgccgaactatgtgtaactctgtgtagtctctcccttactgggatatttggttgatagctgcacccttgccgggttagatatataaaaatgcatgttgatatgactccctaaaggagaccttgttgtaaatatatggaattggcatatttattcttttgggatcgtgtggcgcgccgcccacttgaatatactttctgggatcgtgtggcacgtcgtccacttgaatatactgttatgggatcgtgtggcacgccggccacctatgaaacatgataatgggatcgtgtggcgcgtcgtccactattatgcactgaacatgggatcgtgtggcgcgccgtccactgtatgctttctgtcttacatagagtattcgtagtttaaatgttttagacttgttcctttatgtcttaaaactggtttccccttatagcatgttccctcccgttacttgtttactttgtattattattccctgttttggtatatgtatatcttgcacaggttaacgttgtaggtcctgtctagcctcgtcactacctcgtgagccggggttaggccaggcacttaccagcacatggggtcggattgtgctgatactacacttctgtgccctttttgtgcacagatccgggagcagccttcggagcgcagcagcagctatagtcagggagctagccttcagtccggagacctcaggtagcttgccggcgtccgcgagtcctggatctcctctacttagtttatgttggttccattatcttcggaacagactattgtatatttttcttcagacttctgtttgtagtaactcttagcagttcgtgagcctgtgacactagtttctgggtagaggattctatttgtctttacttccgcacttgttgttgtctttaattaacattgaagtttctatatcatttaatgttgtttctagttatttatttcgctatagtttgcagttgtttagttctcgtttagtggcttgactagctcctgcagtaggcgccatcacgaccccgatggtgggagaattcgggtcgtgacaagttggtatcagagacccggtggtctatttcagaggattgagcttcccgagtggaagtgggagaggattaccatggattttgttactggtctttcgatgactcggaggcagtgtgattcagtttgggttattgtggataggctgactaagtcagcgcacttcattccggttgctaccacttattcgtcccagagattagctgagatttatatcagggagatagttcgtcttcatagggtgcccatatctatcatttcggatcgaggtccgcagtttactttgcgtttctggaaagccttgcagggagagttggacactcaggttcagacgagcacaacatttcatccccagacggacggtcagtccgagaggacggttcagattcttgaggatatgcttcgagcctgcgtcattgattttggaggctcgtgggaccagtttttgccattagcagagtttgtctacaacaatagttaccagtccagcattcacatggctccgtatgaggcgttgtatggtaggcggtgtaggtccccagttggatggtttgagccgggagaggctcggttattgggtacggagatggttcaggaggccttagattaggtcaagatcattcaggatagactccgtacagctcagtctagacagaagagttatgcagaccgcaaggtcagagatgtagctttcatggttggtgagcgagtattgctccgtgtgtcgcctatgaagggcgtgatgaggtttgggaagaagggcaagctcagccctaggttcatcggtccgtttgagattctggagcgagtgggagaggtggcctatagactttctttgccacccagtttatcagttgtgcatccagtgttccatgtgtccatgctccggaagtatcacggcgatccatcgcatgtattagatttcaccactgtccagttggacaaggatctgtcatatgaggaggagccggtggctattctagaccggcaggttcgacagttgaggtcgaagagttttccttcagtgcgtgttcagtggagaggtcagcctcctgaggcttcgacctgggagtccgagtccgatatgcatagccgttatccccatctgtttcccgactcaggtacttctttcttttgtccgttcgaggacgaacggttgttttagaagtggagattgtgacgacccaaagggtcatcaccgtaagtctcctttgttctgtgcttctgaggcctcgaaaaacctcttgaggggttacctcaatttgcgtgcgtagtccggggcgaagccggaaagtttttacaatgtgaaagttggattgtgtgttgaaaatgtgaaattttaagtataatattgatagggttgacttcggtcaatattttgagcaaacgggcccggacccctcgtccgtcaatttctaaaaattcgtagtaaaatatgggacttgggcgtatgcccggaatcgaattccgaggtcccaggcccaagatatgaatttttctgtgaaattgatttttgaaatttattaaagataatgaaaatgaattttgattaaaaagctaaagtatcgggctcgtattttggttccgacgcccggtacatgtcttatatgatgtttaagcgctacctgtagagcttggtcgaaatcggacatcgtttggcgtgtttcagagcttaaaagctaattttgaagtttgaagattaaagttggaaaatatggattttatggtttaattcgttgtatttgatgttatttaggcgatttgatcgctcgactaagttcgtagagtgttaatgagttagtgtgtgtatgtttggtttggagccccgagggctcgggagtgttttggaggtggttcggggtgtttcggacttaggaaaatgcatcagaagttctgcaattttatcacagaaggtttgttcttcgcgaacgcagacattacttgcgttcgcgatgcccagcgtgtccctctctttcgcgatcgcggacgcctttcgcgttcgcgtaggcttcccaggacccccggaccttttccctttcgcgatcgcgtggtctgtacgcgttcgcgtagaccaacttctgaagccctgatttccttatacgcgttcgcatcatctcatcgcgaacgcgatgcttcctcatcccctgtgcttcgcgaacgcatcttttagtcgcgaacgcgatgaagtattttgcccagtgaaatattttaattccaacactgttcatccgcgaccctcacttcatttttcactcgaaccctcttctaaaaaccccccattgacggaaaaccaagcttccaatcttcctaattctttgggtaagtcaattctaacttcatttcttcaatatttcttcatcaatcattgaatttcctaacactaaaacatgaatttaagctggaaattaagggttttgggtttagttagggtttatgggattttgggtatttcaatctcaatttgaggtcgaatttaaaaactaattatatatttgaactcgtggggatacgtgggattgagttttggtccgagcctcgagtttggaccatgtgggcccggggtcggattttagaatttttgaaagaaagctaggctatgggattgtgttattgggttgatattgatgattttgaatctaattatgcttagatatcgttgtttgggagttggactctaaaggaaaggcggttgtagagctttgaattgctagtttcggcatcgaggtaagtgtttgttctaactttggtttgagagattaggattaggatattgattgttatgtgttatgtggtgtcggtgtataggtttggtgacggttacctatgcacccgagtcaagcatgaccgtgggtctttaatttatattgctcgatgctataacatggaatcttgttgttgaattgattctcataataaattgttgaagttgagtagacaagatagcttaaatgaggatttcaagtataaatactttgccgaactatgtgtaactctgtgtagtctctcccttgctgggatatttggttgatagctgcacccttgccgggttagatatataaaaatgcatgttgatatgactccctaaaggagaccttgttgtaaatacatggaattggcatatttattcttttgggatcgtgtggcgcgccgtccacttgaatatactttctgggatcgtgtggcaccccgtccacttgaatatactgttatgggatcgtgtggcacgccggccacctatgaaacatgataatgggatcgtgtggcgcgccgtccactattatgcactgaacatgggatcgtgtggcgcgccgtccactgtatgctttctgtcttacatagagtattcgtagtttaaatgttttagacttgttcctttatgtcttaaaactggtttccccttatagcatgttccctcccgttacttgtttactttgtattattattccctgttttggtatatgtatatcttgcacaggttaacgctgtaggccctgtctagcctcgtcactacctcatgagtcggggttaggtcaggcacttaccagcacatggggtcggattgtgctgatactacgcttctgtgccccttttgtgcacagatccgggagcagccttcggagcgcagcagcagctatagtcagggagctagccttcagtccggagacctcaggtagcttgccggcgtccgcgagtcctgcatctcctctatcttagtttatgttggttccattatcttcggaacagactattgtatatttttcttcagacttctgtttgtagtaactcttagcagttcgtgagcccgtgacactagtttctgggtagaggattctatttgtctttacttccgcacttgttgttgtctttaattaacattgaagtttctatatcatttaatgttgtttctagttatttatttcgctatagtttgcagttgtttagttctcgttaagtggcttgcctagctcctgcagtaggtgccatcacgaccccgatggtgggagaattcagatcgtgacagcgtatatctttatttttaatcttattttttctactatgcttatacatccaactaaacattctcattttcgttactttcaaatataaaggttaacataagttaataatttttctaatttgtagtttaaaatatattataaatacttttgtgattataaatcatcaaagtgagaatataatatgaaagttaaagttgatttatccggaaataacaatgtgttattcctaaaaagactattgtgtcgttatctaactatcttaaactaaatatttttaaccatataattatttatataccctattaaaatctcaacttttaaaaacagttcttaaaaactttgtgtccaataaaaaatttaaaagaattacaagaaaatacacttgacattacaccataataaaaatgctccatatttttaagttttactcgacctagcacatattgtacatattttaaaagcactagcaaattcaaaatctacggagttaaatttatattttcacaatcattgctttcactctcttttcttctcacatcttctacatatgcttcaaggggtcatccgccattactgcttcttccttgtgtcacctggttgcaatgtaagaaaattaaaaagtggaagtccaccattgaaggctattcaatgctttattttcgaaaatagaatttttgttagttgtttggattgtgcgttgttccaattgattgaaataacaaaaggagtttaaaatttcaatttgaagttattttgagtagatttgagcaagattttagttaaatttcaaaaaagacgcaaggaagaaaatgacgtcagttttttatataattatgtataatcttgtataatagtgtatatgggtgtataaacacatcttatacactattatacacctttatacaagtgtatgtagacgaagttcttacacgattttcagttgcaattcttgttcaaaaccaatccaaatctccattaaatgacttcaaattttatatactatctctgacaattctaaataacacacactccaatttttaacaaaatcaaattcgaaatctaaacccacatatttaaacttgttaaaaatctaattttcaccattcaaatatatttgtttgttgaactaatatttgagttatagttgctgattcaaaaattaacttaaaagcttgagcaatattttttaaaaattaaatagtactcctaatttcgagaatttattgaaattaaatgttgaatcttaattaacttattatttttcgactaattaattgtaaattaaaatatataatataaaattaaaaagcaaaaatttcagttgttcttatgtgaattttttcgtaaaattaatcatataacatgaggcagatagaagtagtatataaaattgaacaaagagtcaaagactaacccataattttgtcggtgaatcaaacccgaattaatgcatttttttaatataaaataaaaaataaaaagagaaaaaactggcgcgtaatctggcaaaaagtagcaatttatttattacacacaacatgacataacataaggtccactcatcatatcattaaaaaccctttcttaaattctctctcagtttccccaccttccattttctcgaacatctcaaaatatcaactcccaaaaaaaaaaaaaaaaaaaaaattcaaccccaaataacaagatctatttctacagtaaactctactaatcaaacagttatggattcatcagatgatgatattgaagaatatctattcaagattgtaataataggtgattcagctgttggaaaatcaaatttattatcaagatatgctagagatgaattcaacttgcattcaaaagcaacaattggagttgaatttcaaacccaagttcttgaaattaatggtaaagaagttaaagctcagatttgggatactgctggtcaagaaagatttagagctgtaacttctgcttattatcgtggtgcttttggtgcattacttgtttatgatattagtcggagaagtacttttgaaagtgttactaggtggcttgatgagctcaatagtaagttgtttcgtactattctgcttcaatttatgtgtcttactttctattttagtctgcttcactaagctcccgctatgtgtgggtacgaagaagtgccggatcacaacgtctattgtatgcagcctagccttgcatttatgcaagggttatttttacggctcaaacccgtgacctcctagtcacacgacgacaactttaccaaagactttttttttattttgatttgcgccaggtgtccgagtctcttagaggcccgactaatcccggggtgcacaagccctcggcaaggagtttcccgcaagtgcaccacggttagttcaggttttacccagtccgatggccctcataaattgtttgcacctagtggttttcgaacttgagaccttgagagggagcaaaccccaatcaattgccaccaggccaactcctgggagcaaaccccaatcaattgccactaggccaactcctgggaggaaggatgccgagggtccatttggaaacagcctctctacccccagggtaggggtaaggtctgcgtacacactaccctccccagaccccattaagtgggattatactgggttgttattgttgttgttgtatatttagtagtaactgtttagttctaacatcttacacgacatgtttgagactacaagattcaaagggcactttggtacactatacaatttttagtttaaaatcataatattgaaaagtttattttagacttttttaaatcatgtccgctcaaagtgcatcacataaattgggacggagggaatatgaaagaaaggaactttttggcacaaaaaactattgatgttaaaataaagaaagttaaaattttaagagcttctaaacatagaaaggtattactttgggtgtgtgttactttggcctttaagtaaatcagttgtacattgttgaattgaatgttctttttgggtgatttgtgtttgggaaagtttctttatgtggtaagatatagactggctggcatctctgagtccagtagtggcggaggcaggatctccacgaagggggttcaaaatttttttttgtagctagtgggaattgaacccatgatcgattttgaacccctttgaccactaaactacacttttggattgtgttaaagggtgttcaaaacttaatatatagagataaaaaatagattttaccttatatatacagtgtaatttttcggcgaagggtgttcaccctcccctaaatccgcccctgtctgagtccttagatcaagaatgtaaatatacaataacataatttaacagcatccaatggaaaacaagaatgtaaatatacaataacataatttaacagcatccaatggtaaaaaagcaacttttgttaatctttctaaagtttaatattgctgctatacattggaaataagagacttggaaatgtaacagattggtgaaaatacataatttaattgttgttaagagattatgatgaatggatttgcttattgcttgtagttttgattggtatcggcatctatttgagaatgtgggattcagatgtaccttttagctatgttgcgcggactctccaaaatgtagccgcacctgtgtcggatccttcaaaaatgcactactcttggaggatccaacacgtatccgaccacattttcggagagtctgagcaacatagccttttagattgtgctgaaaataaaaatgtaggtctgagtctgctagttttggatgttctttaataacgggatttcatgagaaagattgctttaatttctgtatcttgccaatgttgacctggtaaatgtcagattgttagcagggtcttcattctgagcaactagcatctggtttccgagtattttttggtgtcacattcatcctattagatgagggctagaatttttgctcgcctaatttataaactccaccagaaatcatttccacaattgttgtggatcctaagttatcgtgaaactgatgttctactagtatgtctttcttctcctgtcgtccattatttttgcgttaaccagaacatgttcttttttcgcccgactgaaatcgttcaagtgcttgcatagttgctgcttcatggtggcaatatacattctgcagcattgttagttgaatgggttagatctgcatcttcacttgggcatgtgtggcaaagtcgaactttttggaacaacaacccagtacagtctctcaagtggggtctggggagggtagtgtgtctgcagactatgcccgtaccttgggagtagagaggttgttttcgatagaccctcggcaacccctaccccagaagaagaactaaaactgatatggatatcaacattgagcccgaattgaccaactgaagatgggcattgttttactttttaaaatgtgtcgggaaaacgcgtaagttacagaaagatgggaatactccttgtatttccgattggcttgagattggcctacctgaactgctgtcattaagagttggaattatctcaacaatgttgtctattgctatcagcccggttatgattgtccgtatgaccttatgttcattcctttattcacaattataagaaaattaccaactgtatatataagggaatgtactcatttctaagcggcaagtgcactcttgcttacagtgaattgtccaccttgtttagccactatagtagcctatgttgctcagactctccgaaaatgttaccgggtgcgtgtcggatcctccaaaagtagtgcatttggagagtccgggaaacatagatagtagcacatccttaactacttaatataacagtacaattaacaatttgagtataaacaaacgtatggttagtactccggccccagagaacctagttttttttttcaatttttgtacatattcaactatttatgttctgaggcagcagaatgacttaacttttgaaatctgatgatccctgcagctcactgtgatacaacagtcgcgaagatgctggtaggaaacaaatgcgatttggacaacattagagacgttagtattgaagaaggcgcgaagcttgcagaagcagaaggattattcttcatggagacatctgcattagattctacgaacgttaataaggcattcgagattgttatccgcgaaatctacagcaatgtcagtcgaaaggtcttgaattcggattcctacaaagcggagttatctattaacagggtaagcctcgtaaaagatgacggagaaggatcgaaacgatcttggagcagttgttgctcaagataagccctgcttttaactgattatatatagtttgttactcaagattaagaggtttttcagtatttattcattattgctgaaaagtacaaggctctagcagccatagcatttaccaattttctttgaagacatttttaagagagctgaggaaaaaaaaactttctttcttactcttgttgtttctactaggaatttcatgttcttgatttagtttcaactcggtcaatcggaagcagcctctctgccctatcggggcaggggtaaggtctgcatacagattaacctttctcagaccccactttgtgagagtttactagatagttgttattgttgttgatttagtttcaactctgaattaagggttgatttgtttgaaggagtaggggaagggtaaagaattggataacagttatagttgtgtttttttctctaaaaagaaaattaaatgtagtattcacgggttcgagccgtggaaatagcctcttgcagaaatgcatggtaagactgcgtacaatagaccattgtggtcggacctttcctcgaaacacgcgcataacgggagcttagcaccgggctgccctttatttgcattgtggaatgtgttctatctttttgtgtttttactcttaggggtcgtttggtaggaggtattagaaaaaataatgcaagcattagttctatgcattattattaataccttgtttggtacgttttttcaacttgtgtataactaatacttatattagttatacatcatacttggcattatcttttgcataagtaatgcatagaaaactatggcattagtaataccaaggttttaatgcatgcattagcatggttaaagacaaaattgtccttcaagttccttaaagctagagaatatggagggcatttttgtaagcaactatttttcttaaaaattatgcaatgcattataattttaatacaccacaccaaacagtagataagaaataatatttgcataactaatgcttgcattattaatcaatgtattactaatacatattataattattccgcactattcttatacatcctaccaaacgaccccttaatgttttggaggcatgagaaaaatctatctcgcgcttggtgtttacgtcagatcaatgaatataagataagcgtttcgcatatgaccttttgtctcttaataatatgattaagtgatatgcatttttatttttaagttgtaatttaaggataaattgtttgatttggtgtatacatattgagtgctagacatgtattgtaagtattctatttgaacgttgttaacatgtctgaatttgtgtattcatgtactccattttatcgaccagtgtttgacttcctaagcaccctatatatcaatggctttgcctatcttatattaatattttataatacaaaaaaaggcatacaatatatagatgtatacgtatatagaaagagaggtacggctaataacctgcaataattccaaaactaagtgttaattttacatcgagtaatttgagtatttactatagtgttcggaccaacttttatacacctcgaccagttcacggaatactcgatatctctcatcagcacatgtatcaggtaattctgtctaccgtgagtgaaatagaagggaagaaattacttaattttgccttcgtaaaatttgattctcaaaccacttcgttaaccactaggtcacactcttccacgacaattttagccgtgaaagtaagaaaaatggagaaaaggaggatgcaccagacaataggaaaagtagaaattggcaccattgggatggtataaaagtacaaagaaaggtggcaccatattctgatattgctcttcataagaggtactattagcagaggcggagccagaatttcaagtttatgggttcgggattctaattattttaagttactgggttctaaactaataatttatacatattcaatgaattttttaagacaaatatattgttcgaaccaaagctactgggttcggtcgaacccggtaacggcactctagctccgcccctgattattagaatagcagagactacttcaagcattgcaataatgaatttgttgggtgaacaaagtaccacattggtaattaaaaagattgggagccttcatataagatatagacatctcttaatgcatgaggcattttacagaaaatcgtgcagatttgatccaaaacagataatatcataccatgttaagagtgcaggctggcttagcccaataaaatctaacactttgtttggattattatttcccatcgttttataatgtattgtatcgtatcgttttatgaatataatgtttggatagattgtattgttaaataatattttgctatttggtttgattgtatcgtactgtaccgtaactgataagtttactaaaatatcctcaactgtttaaatattaaatttatcaaaaaatatgcataaaaataattttaaaaaataaaacagaagaaggcaagccaccttaagaaagcggaacaaaggagcgagacagaagaagacaaaataaaggagcacaactaattagaattgagttaaaagcaaattaggagaaaaaataaaagaggaggcggcaacacacctttaacgttggcggcaaaagttctgaaaaaaaaaataaagtaggttaaaggttggagatttggagttaaaataggaagaaaaaaaagtaaaaggtaaaatagaattgtggagtaataagtgttagggcataattggaaaaaaaaattaggaaacaatcccaccacatcaaattagctgtttaaaaaagggggacttttcattgtttcagaataatggatttaacaatacgatacaaccaatttcaatgaaacaatcaaaacaaatattattttgaaataataatacaatacgatacattgagaaataaccatccaaataagctgtaagtaacaaagattatttcgtttgagcaacaaagtacaaaatattcagtgcagaaagcagtcttttaagtagaaagccgatttcagactggaatataagttttattttgatagagaaaaaggtgcaatattcgattatagcatgaaattttctcattctaattagacattttttaccttttccttggcggcctccttaatcacaaaaagaggatcgtttgcgtggcctttggagttaactcaataaaaaaaaataagaaaattaatgctaattaagcttgatgtaaatttaactttgttagaagtgaataaatatagcacagtataaccagttttcggactggtcattcaaaaatagccaccgtttacaaagtcaatgaaaaatagccactattttactgccacagagaccggtcccgcataatatacgggagttcggtgcatcagtgtacgaactccagcatattatgttggaccggtatactttatgggagactggagtatcggtgctccaaactccagtatattatactggacatttatacttgctggaactccaatatattatgctggagttctagtgtacttatgctggaactccaacatattatgctggagttccagcatagttatcctggaactaccgtataatatgctggagttcaaacatacttatgttggaactccagtataatatactggcttatttttcgggtttgaacattatttttgttcaaatttatctttacataaaaaataattaaatttcgattacttttgaaactggactatttttgaatgaccagttataaatcttgctatttttaaatttctcccaataaattgtggttagtatctgagacacagttttctacatttgggcttcggccaaacccaattccgctaattgctcttgctcttggctatcaaaaaaggcccaatcacctaaaaaatttccaaaacacaggggcaagtgcacatatagcaattcttaggaatgttatttagagattagctaatacttattttgtcctgaaattttaaattaaaaatctcaattttgggacaatttaggatatttttatcctgaaaaattgaaattcaaaatgcactggctaattcctaaataacaaccctttaaagtggctatttggtataaatggagacacaaaatataaatggagacactcctaaatataattatataaatggagacacaaaaaaaaatataaaaccaaagctatctttttctagttctaatacttcaaaaaaccatatgattacataagaacaaagagaataaaacaagatttaattatgggttaattaatcattaaacagttggggtacttttcctacacataattatgaggattcattaatcattaagcaatttgggtcccattcaatttgttttagacaggtgttaagtataattatgacctaaacaaaggtcataatgatactcatgttttaaggcttttaattagtatgtgaaatccactaaatttattctgtatttacaccaacaacgacaacaacccagtatattcccaagtggggtatggggagggtaatatgtacgcagaccttacccctaccccgaggggcagagaggctgtttccaggagaccctcggctcaagacggaaaccagtaacggtatattagtaccagtgcccgctcaagggccaagcgactgaagcgggcgctttaggcccccaaatctttgaggcccctaattattaaaagtaggtcttgtgtgttaattttttttttacaaaaatatttaataatttaaaaaatatatatttctggtatataatccaaattatttttattctctttttcattctcataaaaataccttgtattttagattgtttattcttttttccttctaagctatctattctcataaaaacaagtgttgaagggcattgaataaatcaaattgcacattttcttcattctttatcgagttgttagacactgcagcaagcaaactaacaatgaaattttgttttaatatcaagttacaacttctagagtcaattttattatattgttctaacttgttattctcttttctttctttttctaatttgaaatttgtcattatcttttaatattttacttcgtaggtctatattgctttttataggatcaattataaatatatcaactagaaaatatgaatcatgttattactcaaaattcataaaaaggaaaaaaaggattggaactttaatgcaacctcataatggagctcttgataattttttagtcgacatgaaaaaataaattaaaaaataatgagagtgctcttaaaatatgaacaagtcactaagttgattggaagtgcatatgtgaaaggaaataataaaatatataagaactttgcatctaaaaatactacaaaatataaattttatataatgtacgaaacttttgcaataaatattaaggcctctaagtaaaatttggctttaggccacgtagtaacttgagccgccactgattagtactatcaataaactcataataaatgatataaaatagacaacataatataaaatagcaaataacaacagtataagtaatataagaaatacgagaaagaggaaagtatgctaatatctagaatctaaagccctgcatcagtagttgatcagtagcatcctaaccctaactcctaaatgtctagtctcactctagcgcgctgtagaaatattcccaacttctccctaacctacaactttaatgatcgtcctccacaatcccctatcaagggccatgtcctcagtaatcctaagtcgcgtcatgtcctgcctaataacctcttcccaatatttcttaggtctccctctacctctccgcgtgcccaccaccgccagtcgctcacaacttctcaccggtgcatcaatgctcctcatctgaatgtgcccgaaccatctgagtcttgtttcccgtatcttgtcctccataggcgccactcccaccctttctcgaataacttcattcctaatcttatccatccttatatgcccacacattcacctcaacatcctcatctccgctacttgcatcttctagatgtgtgacttcttaaccggccaacactcggtcccatacaacatggccggtctaaccactgctctataaaacttaccttttagtaactgtggcactttcctgtcacacaggactcccgttgctaacctccacttcatctaccccacccttatacggcgtgtgacatcctcgtcgattttttcgatctcctgaataactgacccaaagtacttgaaactacccctctgagggatgacttgagagtcaagcctcacttccactcccgcatccgtcggctcaggcccaaatttaccctcgaggtattctgtcttcgtaattatagttaattaacgtgcattttcatctcatttattatttaatcatggtaaatttaactatcaattctgcttttattagcacaaaaatagatcaacaagtttgacacacgtttttctattttttcctagaatacttgtatttcttgctatttttgtttctaaaatttgataattataagattacacttgctctgagttaaagggtgtctaacgggggggggggggggggggggggggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttttttttttttttttttgtattttgtataactattataatttatgaatacaatgaagatggaaaaaaattgcacttataaattgtaagtgttacatttatttcaaaattcaaacttacaaattgaaaggtttacatttaacaagtaaattaactaaaaaggagtaaattcaaaggttttacattgccttagactctaaaaccttaaaaataaaattaaaatctagcctttaaatcggtccgggccagttaaccgattctacagggattttgattgaccgggtttgaccgatccggttaaccggtagaatttaagtaaacggaccaaccccttatccctttaatccagtcccacccggctcccttgcatctgtctgggccgattccagttttaaccttttgggccggtccaaaaacgggctgacccggcccgttagacacccatactcttgagtccaagaaaatagtagtaccagataatagcattgatttcctactactactattactaaaatgttctgaaatcattgcttgttttgcatgcatgtgacaatcatcatttcttcactttatctatacatattttattcttttctcttcttttggggttacttaattattatattctatttaattaaagttcctagagtaatcaaatcaagctattaactgagggtttgacaagtaaacattttctcctagtatcaaggaagtgaaaaggaagaccattttctcatggaaagctacatcagagcaaattatgtcttgtgttaacctaatacaagacaaacaactctcttgttaggtcaaaaagagacttaattacctaccactttgatgactaatgtcttaaacaacagcatcttttaacatattttttttgtttatttattccgtccggtacacaaaccattctatgtttacgctagggtccggagaaagatctcactattcgttagatataattgtatagtacactaaattatatactattatgctaagtggcactcagcttctcgccggcgatcaccgtcgcctaaaatggcagtcgcaaaacttcgttgtgcctaataccctttcaatagctattcatacaagcgtatgatgtttaagtcgcactctaaaaagtatgatgtaggcagtctaccataatgcaagcgtcattagatgatttcacaattcgaacctgtgactgactataaatcacacgaacgaagataattttatcgttgcgccaaagctttctttttatttaattttgtatcaaagtagaattattttgaaaagtaacaccaagccaatttgatatatatgtaccaactacagaagctacaactgaggtttcatagttgtaattacactttcacctagcccctaaaacctattagcgtggtaattaattcttctatttttgatgtacaaaccttttaactttggacaaaaggcatgaattatgaactatgatcgcacaaagaaaaaagaaaaagaaagcagtttgcatgcgaatttttggttggtaaggggaaaaaaacattttttaaatttatgattttaaatatttttgtagacatcgaaatttaaggggatcaagccaaatcttaagttaaagataccacatgacttttgaaatcctaggagtctattagggtttcttggaggttactctaccaaggcgtctcaaaatctcataaactcacgggatactcacaaagagatcaaaatatggtcggatacttcttgacaatcaaatagctcaagaagacggagatcaaatatatctcaggaggtctgcatgatcatacattcaagaaatacgctgcttcaaccctcgaaacatggagataatcaggagagaagaatcaacaaagagacagaattgtactcacaattgattagtaaaaatatttttctcttattttgtgattgcgatttatttttcatatgttgaaaattagttgcaaacaatttcataatatttttatgattatagaagcttgccattaagagcatgataaaaacttttaagtttcaattatttttaaatttagaaaatagggtcacaatgaactgaaataggtggagtattagagtctgtttggaaagccatcagataattggaattggtataattactagagtagtaattatacaacctagtaattatgctattgtgtaattacaacgacctgcttgtttgtcatagtgtaattataatgtaattacacgtttactgtttggttgcacaagtgtaattatacagttagattaaattttaaatgaaataattatcaaaacttaaaagttaatataataaaaatatgcctataaatttttataagtataaatgaggagtattatatttggtatttaagacatatatttttttgtgaatatacatgaattagtaatcatatattaataactaatattttaaaaataatttttatatatattattcaaattaataatatttcgtttatatacttacaaaaacaaaaaatatgagttttgtaagaacatcatggaattcatgtttgaaaaaataaattaatatttataaatataatgtcataacattattcaaatgtttgacaaaccaaatctaccaattctgactaaaaaatgaacaacatgcaatgtgagtcaatactattaaaacaagcaaattggaactatgaatataacacaattttaaaattatatatatatatatatatatatatatatatatatatatatatatatatatataacatatgtcaaattccaacatgataataaagttcactacaacttaagattaggaatcataataagtttataatcatattcaacaatgaaatttcactttagttgcatcattggtcattgtatgccaaatttgttaatggctcactgtttctaatattaggaggtgtagtttgaacaataaaataaataaataataaaatataagcaattacactgaatcacaaaaaataaaagtaaaaaataaaagataaataatgtacaaagaaattctactgtgctattttgtatcaaagatcgactgagaaagtcactcttataatctcagatcagttacaaattaaagattgctatgatttaggaaaaaattaaattctattaaccagtcagtgaggacaggcaaatacaaagaaaaagcagcaactaaactccaatcattttatattaataaatattaaaaagaagcaaaaaaacaacaaaagatactctcatagagcatggcttctacacaataagaaaatatcaaaataaattacagtcccaaccaaaataaataaataaattagtattcagctaaccacatgaaaacaaatacagtatatagggaaaagacagctcgatacacaaaacgtcccacattcacacagcgtgtggagaaggaccgcatccagaaaatcaatttcaaacttgtactacataaatatgtgtaggagagagagctacttctttgtgtttttggttttccatctggaattcagtacccgtattggaatctgactaaatccgaattcacgcagggagaactacttcaagaagtgagaggttgttgtcttccatttgaaccattttggccatcataaagcttgttatttgattttccaggcttctttttaagtacaattgtccaagtaatggcttctaaaataagagcaattcctccaagaattgaaaggaaaataatataagccaatttccatttgctttctggcttcaaaatctcaagacctttaaacacattgatgattccaagaacaagtacaccatatccaactccatggtgatacatattccagtaaaatctgtacttatgatctttctttggcctcagaaatagcgcgaacacctacaatttttacgtgaaaattatgggatcaggattcaaataattccaatataaacaaaaaatgctagttaatttattctcatatgcgtaactcttagctagtagagttacgcattacctatctatgctggtggaaggaagcagatacctagtggaatagttgaaatgtacacaaactgactcgaatactaccattataagtaaataaaaacactccctataatctaaattgatcttcatgattcagttacaagtgggggtttgccatatttattttttgtgtgtgtagaaatgacaccatgtagccactttaaatgactactatttacgaattagccagttcatactaaattccagtttttcaattcaatttttcgggacaaaagtgtcctgaattgtcctgaagttgagattttcagtttaaaatttcatgacaaaaagtaatggctaatttctaaacagtatcctgaaaatggttatctatgcacttgccccttttttagggatttgttacacaaatagccaatcagattcaatgtttactttttctagtcagtatacatagattatacattaattatacatatattatatatgaattatatataaatgatacatgtgccagctatttttagtttaacatattaagtgggcagctatttaggttaattctttttttagtttagatccaaaagttgataatctcctttaaattaaagaaactaaagataaaaaagttaaagaattttaatgtgaaagtatacctgaagagttgcaagagagaataaagcaataccaaaatctctatgggaagtatattcaattcctttagattgatttccaagtttcagaccagttgcccaaccagcaactccaatagtataagatgataattgacaagccacatgaacataaaaccacactggatctgcaaatgttcttagatacctagcaatcataattccaattggaaataatattccccaactcacaacattcagaattccatgaatctgttcaccataaattcaaatatcagaaacaaaaatatttttttaaaaagatagcccggaacatgaagcatcccgtattttcacaggctgagggaaaagactgcacttcaaggcagaggcagatctatgtgttatgttgaggggtcaccggaccctgtaaacttcggtagaaatcttgtatatatatgtatgtatacctggaaaatagttgatttaaatcacttggcaccctgaacgctaaaagcctttaggggccactgattgaacaaaatattgtgcgcccgtcacgttaaaatcctgggtccgcctctacttcaagaaggatgtgatgtaaaaaaaatataaaaataaaataaaataaaagaaattgaactaacaaaccctctagtggttgttaaagtggggtagaagtcataggtgaccaaagttcaaatcatagtagattgaactttgatgaaaaaacctcgtgctcgtgggagataacagatattcgatgaaaacatagaggtgcatgcaaactgatctggacactgtcgttagaagaaaaaaaaaagtgtaattattgaagaacttacatttctattcttgagcctagaatcctcaggaccatttatactcttccctttcatcaaatcaagttttcccttggaattcaaattttcaggctgaaaatcatgaattccagggaatgtctcattcaagactgaacttcctacttgccaaacctgattcaattctatcattccttcaggtaattttacactagcaaaaattaccatcattccattactatacatagcctctatatttgtaacgcgatacactagctcccctggcacgatggatttatacgaattcaacttgaatgttttcgcgacaatggaaccattggattgtttaaacgcgatcaacgcttgtgtaccaaccattcctgttgaatttggattaattccccaagcaatccaaccattaggtttagtaggagtagctacaaaggcaaaatttaaggtaaaatccttggaattgtaattccaatggatgtaacaatttagatgtggtaagtcattgcaatgttcatataatctgttgtttgtaaacttttgtgatgtacatgacatggaatatgacaatttaggttttaaaatcaagaacataaaatataggatgacaatacaacatgattgatacaatcccatgtctaatgttcttgaaattcttggaataacaatcttctctctttcttctttttatggttgggttgggttggggtggggtgggtttgggggtgggggagtgtgtgtggggggggggggggggtgtttactagtatagttgggaatgagaacttgtggttaccaactacaagtgggagatataatttggagtatagcaaatgcatataaaggcaatttctggccttatatagtagcaaatggactttgagtgtgactttacctttaaaccggatttttaaatggtaattaaaaaataactacaatttcaaaagtaatgaaaatttagcaaagataaatttgaaccaaaatactatccaaattcgaaaaatattccagcataatatattggagttcgatttttttacatgtgaacttccagcataatatactggagttccagcataatatattggaagttcatacatatgtgctccaatctccagtatattatgttggaacttttcatgtactggagttccagcataatatgatggaagttcatacacagatgcaccaatatccagtatattatgctggaactttccgggttgcagcaaaatagtagctattttacaatgactttgaaaactttgactatttttcaattgtcagtctggaaactggctagctcgtgctattttcactataaggtgacatgattggattctttttcctttttgtcttttttcctgctttaagaaatgaaagcaagtttagtggttttaaaatgggatataaaaataattaaaaataactgttcataatttatgaaattagtaacctgaaacataaggtatataatttattacactaggcaaatttacagtataatatgaaatcaatatatataaattaaattcttaacttgtatatgtttaccgtataaatttgtcaagttgatttttaatagggaaattaccagctatgtccatttagaagtagcccattacaaaaattggccaattgataaatattactaatattagccaaaatggtcaattagctatttgtagcaaaaaaatatcaaattttcactttcttttgagtgggtgctattagaatagattgggtacatcttaaggagcttgaatctcagttttgggatgatttggtgaagttttgacgtggtttgaattgaaaattcgaagtaaaaactgaatatgaaaaaaaatgatatcacattgtgtatcacatatgtatcatatttgtatcgattgtgtatcacatgtatatctgtgtgtgagatacatgcgtgatacatgtttgatacatgtgtcacagaagaatttttttacatcgatttaattataaattttgatacaaaaccagtccaaatcacctccaatcttcatcaaattttgtatattgacttatctatatgttttcaatgaatttcgactatacccattaaaaaatgccttgtttgttttgatttttgaaatattggctagaggttggtaagttgaaacttatacgagacatttctgtaagtttccctttttaataagagcattcgatttaagataaaaggaatttaatttttcctcattcaactagacatgtaggcccaagataaagagaattcatctttcatttccttttctttttctgaacataaccaaacagagagggaaaaattttcaatttttttttaaatctggtatccgatattgtattagagtttctattaattcagattctcgttgtataagacccactaaataaggaagtggttcctattaagattttatttttattttagagagttcgagcttgaaagctatgattattggtgggaatcctatccgtcccatcacaacgcatgacggcgatattcttctttttgtttctcctatcctctctcaagtttccataaaaaggaaaggagtttgcagatattatgaagcatattatcctttcttttgatttttttaatctatttaagtatttaatattatcatttctcttcacccaattactttctttttccaaattgctgacataattataagattcccatgctatgtaatgttaccatcatttctttgtctcaaaattggaccacaagtctcctcaatatccttccaaataaaatggagctaaaaaaacaaagaaatgagtcaagttgtttgttgtagcatacatagagtttgagatataatatgcaagaaaattttggaatttttaggataatatcgtaaaaatagcacgatatagtcatttttcgaattggtcattcaaaaatagccagcgtttaccaagtaaataaaaaaaaaaggcactattttactgcaacaaagaccggtccagcatcatatattggagttcggtgcacctgtgtatgaactccaacataatatactggagactggagcaccggtgctccaaactccagtatattatactggaccggtatacttgttggaactccagtatattatgctggagttctagtgtaattatgctggaactccatcacattatgctggagttccagcatacttatcctggaactccagtataatatgttggagtccaagtatacttatgctggaactccagcataatatactggcgtatttttcggattttgaacaatatttccgatcagatttttctttatatgaaaagtggctaaatttcgattacttttgaaacaggattatttttgaacgaacagttgtaaatctggctatttttgaatttcacccgataatatcccactgtttattgaataaactccgacatctatatataccaaacaaatgaatatatgacgtgtaatctggtttgagtaatttctacatgttgagttgaaaaataagaacacttttatttagtccaataccgacttgactaattacataattaaatttgattaattcaaaataaataaaacataattaaactcgactaatcatcgagttcataaagaaaaaaagtgtaaagagaaaatgtgtcattagttcttatttttttactacattcaaaaagataaagttatttttctatatattttgggcacttcgctactttggattctctattaattttcttgacaatattctaatgcccatgcaaatgatctacgcaattgttttttattaaattgcatatcttttcatcttcttgtcaaataaattattataattacaaagggcatcaaatgatgattatgattaataaagacagttttgttggatcaaatgactatgttttggatactaaaattggagaactttgaagaatataacttaaataatactcgctccgtttcattatatgtaacaatattttttttattcagttccaaaataaatgaaaaactctctaattcttttgcatattttcaaaataaaatatgaaagaaaaatgaagttttgggctgtgttttgagtggagaaaggtgttgactatataaaaggcaaatgaaatacaaggtctttcattttaatttccaattctaaagtttctacaagcaaaagataaaacatttctgaaaaataaaatgaagtttaaccctatattcatctgttgattctttttcaaataaaatattaggaaacttttacaactcaaatagtaatgttaaccttgaatcagtggcgaacccaggattttgtgcaagcgggttcaatcttagaagtacataattttagtcgtaaaatagtagttgtcaattggtttcaaataaaatatttatacaaaatttacgcaactttaatcgtaatttatatatatacacagtattattttttgatgaatcggattcagttgaacacgcttgccaattcgttcgtgatagtcttcattgatgatattttgatatattcccgcagccaggaggagcacgagcagcatctcagagtggttcttcagactttgagtgatagtcaattatatgctaagttctcgaagtgtgagttctggttgagttcagttgcattcctgggtcatgttgtgtcagcagagggtattcaggttgatccgaagaagattgaggcagtaaagaactggcctagaccagcatcagctatagagattcggagtttcttgggattggcaggctactatcgttggttcatagaggggttttcatctatcgtaaccccgatgaacgggttgacccagaagggtgcccagttaagatggtcggacgagcatgaggcgagctttcagaagctcaatacagctctgactacggcaccggtgttagtttttcccatcggttcagggccttatacagtttattgtgatacatctcgtattgggcttggtgcagtattgatgcaggatggcaaggtcattgcttatgcttcgcggtagttgaaaattcatgagaagaactatctggttcacgatttggagttggcatccattgtctacgcgttgaatatttggaggcattatctgtatggcgtggcatgtaaggtgttcacggatcataagagtcttcagtatttgttcaagcaaaaggagttgaatttgaggcagaggaggtggttggagttgttgaaggattatgtatatcacccagaaaaggtcaatgtggtggtcgatgccttgagtaggaagtcagccagtatgggcagtcttgcttatattctggtcggtgagagaccgcttgctttggtgttcaagccttggctaatcggttcgtgaggttggatatttctgagcctagtcgggtattagcttgcacggtcgctcgttcttctttattggagcgtatccatgatcggcagtatgatgatccccatttctatgtccttagagatacgatgcagcgcggaggtgccaagcaggttaccttagatgatgatggagttttgagattgcagggtcgagtttgtgtgcctaatgtggatgggcttcgggagttgattttagaggaggctcacacctcccggtactctattcatccgggtgccgcgaagatgtaccagtatttgcggcagcattattggtggcgtagaatgaagaaggatatcgttacatatgtggctcggtatttgaattgtcagcaggttaagtatgagcactagaggcctggtggattgtttcagaggattgagcttcccgagtgaaagtgggagcggatcactatggattttgttgttggactcccgcagactcagaggaagttcgacgcattatgggtcattgttgataggctgaccaagtcagcgcatttcattcctatggcaatctcctattcatccgagaggttagctgagatctatattcgggagattgttcgtcttcatggtatgcttgtatctatcatttcggatcgaggtacgcagttttacctcgcgtttctggagagtagttcagcgagagttgggcacttaggttgagttgagtacagcatttcatcctcaaatggacgcacagtccgagcggactattcagattttgaaggatatgcttcgagcttgtgtcattgactttggaggctcgtgggatcagttttttcccttagcagagtttgcttacaacaatagctaccagtcgagtatccagatggctcttatgaggctttatatcataggcagtgtcggtctccagttggatggttcgagccaggggaggctcggttgttgggtacggatctggttcaggaggctttggacaaggtcaggattatttaggataggcttcgtacagctcagtccaggcaaaagagttatgcagaccgcaaggttcggaatgtggcttttatggccggtgagcgggtattactccgagtgtcgcctatgaagggcgtgatgaaatttggggaaaagggaaagcttagccctaggttcattggtccgtttgatattcttgatcgagtgggagaggtagcttatagacttgcttcgccaccgatcttatcagttatgcacccagtgtttcatgtgtccatgcttcggaagtatcacggcgatccatcccacgtgttagattttagcactgtccagttggacaaggacttgtcttatgaggaggagccggtggctattctagaccggtaggttcgtcaattgaggtcgaagagttttccttctgttcgtgttcagtggagaggtcagcctcctgaggcatcgacctgggagtccgagtccgatatgcgaagccgttatcctcatcttttccctgactcaggtacttccttcttctgtccgttcgaggatgaacggttgttttagaggtggagaatgtgatgacccaaaaggacatcacttgctttaaattaaaatttgtgttttcgaggccataaaaacctcatttagagtcacctcaattttcgtgcatagtccggacgcgtagccggaaagcttaaatatgaaaatctatgaaaaataataaaatttgattataaaatgagttaatttaacttcggtcaacgttttggataaacggacccggacccataatttgacgatctcggagggtccgtaggaaaatatgggacttgggcgtatgctcggaatcgaattctgaggtcccaagcccgagaaatgaatttttaaagaaaattattttttgaaattgtttaaggaaatttgaaatgaaatctgattagaacgtgatggtatcgggtccgtatttttgttacggcgcccggtacaggtcttatatatgatttaagacatttctgtaaaatttggtgaaaacggacatcgttcgacgtgaatcagacataaattgctaaagttaatgctttatgaagtttaggaaaattctttgattttgaggtttaattcgatatttgtgatattattttggcaatttcatcgcacagataagttcgtatgatatttttgagttagtacgtatgtttggtttggagccccgagggctcgggtgagttttgaataggtgtcggagtgttttaaacttagaaaatctggattttctgctgcatctggtgttcagagatttagtgctatgcgatcgcatagtaagtcccgcgatcgcataatgtaaaactttagggtcctgttttgttatatgagatcgcataggtccctccgtgatcgcgtagagtaaattccggaagttcacattttgttctatgaaatcacaatatgttaagtcatagccttcatttccttctatgcgatcgcgtggtatagtccgcgatcgcagtgctcagccattcttaccctatgtgatcgcaacccattgttcgcgatcgcatagaccaaaatctgcccagttaaatttttaaaacccagaacagtagccatacgggaatatcaccaaaattcataacctctttttctccaaagctcgtaggcgattttgaagtaattcctcgccataatctcttaggtaagtaatctttaacttgttttcttccattttcatcaatatctactagatttctaggcctaaaatatataattaaaggtagaaaattgggtatatgggtagagttagggcattttgattatttgggaatttgacctcgttttggggtcggatttcaaaataaattatatattcgggctcgtgggtgaatcggtgatcagattttggttcgaatctcgtgttttgaccaagcgagcctagggtcgatttttgaatttttggaaagaatgattaaaaagctataattagacattgaaattggattgtttagcatttattgatgttatgaagtcgattatgtatagatacaattgatttggagccgaattcgaaaggaaaggcggtatttgaggattgagttggccgtggaagtttgaggtaagtgttcggtctaaccttagcttgagggattaggagttgtgtcctatttgttaattgcttccttttgagaacgacgtttaggcatgatgacgagtatctatacgttagtgtcgagcatgaccgtgagtcttaaattgatagttgttgtgttcttaattgatactacgaatactttaattgattattctcgatactgagcaaggatttagtttattttcgtgaatcttatttatgactgaatattggtagtacatgagctgagtaggagttgagttaagattggttatagttgatactcccttgccgggatgtttgttttgatatttttttcccttgccgagaagctattatattgttttgttcccttgcccggattctttgtgattttgtgttggcatgagatggaagcgggtggtacgcctaccacaagatatgatgaaatgggagcgggtggtacgcctaccacaagacatgttaaaatgggaacgggtggtccgcataccacatgatttaaaaaaatgggaacgggtggtaagcctaccacaagatttaataaaattggaacgggtagtacgtctatcacaagatataataaaatgggagcgggtggtacgcctaccacaagatatgagaaatgagagcgggttgcacgtctgcaacgagatgtgaaccgaaagtgaaatctgcctttgtttttcttatcctagttagaagttaaagtttggtttccttataattctcttgagattctgttttcccctccccaacttttaattgtttagttccagtccatttttccgatatatatataactgcacaggttatctggagtttggtcctagccttgtcactaccccagcgagattaggccaggcacttaccagcacatggagtcggttgtgctgatgctacactctgcacttatgtgcagataccagagcagcatttggtcagcagcagtaggggagccagccttcagtccaccgagattccgaggtagccctgcaggcgtccgcaggcccggcgtctcttctattagtttttatgttctattatcatttgtactcgagacacactatgttctttctttcaaacacttatatgtagtaatcatagatagtccgtgaacgaagtgacaccagtttctgggtagagacatatgttgacttttcgtattatttggtttaatttttgtctaagtcttccgcttaatctcatattccgcaattatttagatatttatcacttgttaatataagttgaaaagggattaaaacaaaggagttaaagatttttaattttgtggcttgcctagcttctacaagtaggcgccatcccgactcttgggggtggaaaattcgggccgtgacaacttcaaggaccaagaaacgtgacaacctaaaccaatatatcggctagaaaaaaaataaatagtacatttgtttcagttatttatttaaagattccatattttttgtgggattgttacatcaataatcgaccagattcaacattaatagaacaagcaacttgggatattgaatgcctaaaccaaataataactttcttcttcataattatgctaactttaattttggttcatagatagagctgtcaaaacaaattaacccaatccagttcaacccaagtgaagtagagaaattttatattgaatgttaatattatgatatgtttaaaaatataagttttaaaatccacaaatatgacaagcttaagattacaaaatataattttattttcaattttttattatttttttccgagtttaattatgtcaaataaattgaaacgacgccaaatagtagccactaatatcagttgagtgcaaaccatttcttcatttcttctgatgactttagtatagaaaaatcttctttcccaaaatatattgtttcccaattcttcaaatatttcttgtcggagaaaaccagctttagaaagaggagctggaaaaagactgcaaattgtaaattcccaaaataagaagaaatgttttgaggtgcaatactctttatcaagacgaagataattcccacattgcctgctctttccacggccacacagacactaatggtagttaattatcctctctcaattcttgattttgctgcttaattcctgtgttttattttctatatataaagaaactctggtcacatgacaacaactttattcccatctgaggaggggattgtccttagaaactattccacaccattagcatgattattaaatcttcgtccctttttttggcgtcgcatcgccaatttaaatatcaagagtttctagttaacaatgaggtgttcgattcactttattttagttttctttctaaaatggaaaaggttatccggttacctatgttgcgaatgttgtcgtgtgtgtcggatcctccaacgttcgaaaataatggagaatccgatacgggtaagacaacattttagagggtccaagcagcatagctggttacggctatgcatatttatgagcaggagtggatgtagagaagaggatacgggtttccgggaacccagtaactcttgcataaaccctatatttatattaaaaaatttactaaatactggtaaatatctaactgggaacccagttattattgcatattaatttaaaattatggtaggaacccataagtctcatatcctggatccgcctctgtttatgaggaaattgagcagcataagaaatcttaaggtgttggagtaaagaagttttcagtctgtcacattgagtttgctaatacttcttcaaacttatttgtttagatcagtgaacctcacctcagttaaaagcccgttgtatccttcttttgctttctttcattagtagatgaatctggaatattatattaaaaaaagggggtaatgttaaacaggattaataactatgaggcagagtgttgatttatcgtctaccccgccccttatggcaactttttccaacattgatgagattgaaggagtttgagcctcttataatgcttggctaagttgcacggactcttcaattttggtgccgtccccgttccgatacgagacttggacgggtgctggagcgggaaacgtcccggatacggtcaaccgacttcggacactttaaccggagtccatcgacaaatttgggagaaaaattgatattttgatttctcaaaatcaaaaattaaacagatttaagttatggaaaatggcataccttcaatgttgtagtagtatttttgtctcatatttgatgctttgtgtgtcggagaaaccaaaaattcaacttcatgtagacctagcatgtagtctcaatatttacaatatttttatagctctatttcttattattttgaattttcttagccgtatccccgcacccgtatccatatccagattcgcacccccgaatcttaaaatttagattttgccgaatccgatactcggtaccgagcccgtatcggatacccgcacccgattcccagcaacttagatgcttggtttgtgggagtggattttaactcggattaacaaattttgtgtaattgaggtccaactagtgtagtagtaactcagacccttgctgatcaatttcattgtttgatggtcccttcttccttccattgacttcatatgttacttgatttgggtgtttattggagacaagaaagtgttgcccacaagctcgcgatatttcttagtatattactaaaagctcgcgagataccatttctgtctaatactaagttatagataagcaggtcagatgaggataaggggtttgggttgtatagcgtctagtaacatgttgtcatttgaaggaaaacaattgtgttaaatctgctgtaactttctatgccagaagctggaaaaaaacgattgaggtcctagaaaaaactagaaatgtatgagaaaaagcaagaggaaggcaagatagatagagagaatagatttagggccaaataggatgaagagtgttacaccatgacggaggctgggcgtacaaggacgggtcaaagaaaaggaccgacaggcttctaggctggcaagcttacaaagaaaggacgcacatgacatattctatgaatctcatactggaataggataagaaaatgaagagtttcataagacataacacaagttcacatggtatgcgtgctattggattcgatgatggcgtagatcaatggacaaatccgtgaggtctgttggactaaagcggaaatatgtgatgaacttgggcagtgataatgggaatttacaggaatagtccgccgtgcgtttggacatctaaaatttccactgtctgagttatgttttagtctggagctacatatgtaggttgaggtgaatagcagtagttgagttaccacgatatcttccattactggcttgaggtgaatagcagtagttgagttaccacgatatcttccattactggcttgcttctgtgttgatttatcgtctaccccacttagagtattacttactcagacccttgtttcacgcttcttcctccaattgccttcatatgttacttgatttgagtatttattgtggtgaaaaaattaggcaccccaattgacaagaaattattgcagacaagtactcctagtatttggatatttttttgtgcattattaaaagtgcacgagataccattttcatccgatataagttatggatgagcaggtcagagaaggataaggcatttggtttgtatggcgtctagtaacatgctctcatctgaaggaaaacaattgtgttgaagttgctgcaatttagtacgccagaagctgaaaagaggggagcatggcggtttctaggggtagtccgccgctatattgctcagactctcgaaaatgctgctgcgaccatgttggatcctccaaaacgtactacttttggaggatacaacacgcaacgggcggcatttttgaagagtccgagcaatataggtctgccatacatttggatatctagaatcaccactgtctgagttctgctttctggagctatgtatataggtgaatcttttagtttaagagtacaaaaatccaacattttgaagtggatagaaggcatttctcagcagtgtttactgtggcaaattaatcagttgcttgagattgatgcatgattagtgagtcacttgactttctagcttctattagttaatttctttgctattcaaactttgatcatcttatccatatggatgtttgcttttgagcaccaacaggagataaaggattattttctctggctccgccccaccaaggaatcgatggagaatggagcgacggatctggagtaatcgtctataagtggaacaacaaggataagaggccaaatacaggaagaaaaaactggaaaaagagatggagctgttgtgctgagtatgatgaaaatgccccaccttgtaggcaaggatggcatgtctcatacgatgatggcttcacattatactaatcatatgtgatcacttgttcgacccgtggaagcagcctaataaagtgtaagactaggtacaatacacccttgtagtctggccctcccccaggccccgtgcatagcgggagcttagtgcatcgggcaaccctttttttttttaatatatgcgatcacttttattttagctacaataaaatgcaaaatttgtttcaaattcccgaggaatgtgaagacatacatgcaataagagatatttttattgagttgaggtgtctatttgatcactagctaagttagaatgtctatctgaaactacaatagtatcaaaagctgacttaaaagtggccggcctataactattttcctaattagttgcaagtcgagagggcattcaaccaacttcaaggatggtacgtcctatacatgattgattaatggcgattctcaacgacatctttaagatcacaaagcttactaatcaaatttgaaaaaaaaaatcaaaacttcgaatacttttcttagaaatgtattattattattactattattattattattattttcctgcatatagcatataattaattgtctcacaactatttatttaaactatttcaaagctcacaatcatatttataaattcatgtaatttcataaaggttaggttttggttggtggactagtgcgtccctctgcttcttagtgtgtcttccactatcaaaaaaagcaaaataaagcacagctacaaatagtagaaccaactataccattcacacaaaaccaaaaaatggaagctccaattttcacaaaactcatatatttcttcactatttttcttactcttttatttataatcaactctgtaacaggccaatcaccatgcaatggtacaatagctgagtgtaacgaagatttggagatattaatggagtctgctattagtagaagatttcttgaagaaagaaaaaagtatatttctcctggagctttgaaaagatatcaaccggttttaaccctcaggggttggcctggtggcaattgacttgagcattggggtttgctccctttcaaggtctcaagttcgacactcactaggtgcaaacaacttctgagggcatcggactgggtaaaacctgaattaaccgtggtgcacttgtgggaaactccttgccaagggcctgtgtaccaccggaattagtcggggctcgaagagactcggacacctggtgcaaatcaaagagatcaaccggtttgtaatggcggcggtggcggcgaaccgtattcccgaagctgccttccgccgccgtcgaatccgtataatagaggttgttctaagtattatcgttgtagaggtgatcaatgaaataaaaaaagggtgattctgaaaaagatagatttaataagggaggaagtctagaaagatattattgacttagcaagaataggatttcatctaatatcattgacttaagcttgtatgagaattatggcaaaggaaagaaacagaggaagaacaaaatttccataccactaaggtatttaatattttatttcaacaaacatagcttctatcagtttatcaagcagtgatctctcaaatataaatattttcgatttctatcggaagaacaaaaatcgaaactctatgcaagtaaaatcctcatatttctgtcaacagataaatcctcagtttccttattgtataacatctccaggcaaagatataacattaccatgttggtctaaatataacagatggatccctatcttctttactgtaacttcttcggaccatgcttctatcctttccccacctttaatcatctcgccatcaaaacgttcatttaaggccatcaaaagccttatgtaagcaatatctctatgtccatcaaaagcctcatgtaagctatatttccacggaacaattacagtctctttatgggcaatactaatcctgtggcatggataaggggctgcatccaaagagtcgataacaaaccagagaaccattcctaagaagttatactcatcattattatgtgtcggcatagtcaaacacatagatgaagctgttacttgattcctgcaccattctggaatctccttgcattcgagaaaaatttctaaatcaagctgcatcggacaaaaactcaagatcattaatatgagagagagagagagagagagagagagagagagagagagagagagagagagagagagagagagagagagagagagtctgacctgatcttcatgttctctagattgaaatgctcgagcaggtgcattaaagaagccttcattgaatggattctgcagagaactacaattaatcatattaaatcgctctacagaagggaggttgtccaactctgtaatcttgaccaatttttggcaattataaagttcaagatatcgaagattctctaaatttgatactgatgggagtgtttgaagattcggacagtcattcaaacataactcttccaataattgtaacttagaaaaatcaaagggtagacaatagaaactgttgccactcaaatctaaatattttaaggaggataagctcccaatattcctaggaatatcagcctcggacaaattacagtatataagcctcaatatggtcacaaaatttgacaaggaatattgtatctgatggactcctcttccagaaatactccttttggcctctaactttcgacctcccactcccaatgattcaagatttcttagcatttcaacagatctaggcaattgttttatacccgtatcaactgcagaaagaaatcttagacttttcatatctccaaggttatctggcagtgtttttattgatgagcagtcactaatgctcaagtaattaacggatattagctggcatatgctgcttggaagatccgtaagttttttgcaaccagatatatatagttcaattagtctggacaaatttcctattgatggatggatctccgtcagacctgagcatccatagagatacaaagcctcaagactcatcgaaccattgaagtttggagtgcttctgagttgcttgcaatgagagagatccagtttcttcaaacttctacaacactaaaagtaaaccaaatatggtttcaattaacattttctttcacttagtggcaaacagtacacatgaaattgtaaaattgtgtaacaaacctgcaaattcaattgaaattcttggatatcactcccccgcatatctagaactacaagattcacagctggaaaatttgatggtatacattttaaaggacatcttttccaagacaaccatttgagctccttggataacagctcaaaatctccactaatatgtaactcatccattataagaaccctaaggtttttcattttcttaaatgctttggtgctcaagtgcagtccctcaaatgctagttgatctaccttcagtacttctacctttttggaaccctgtagtttggagaaaagattagtatctgaagaccatcttaagtcccagatattaagagggaagaatgctttataccaattcaaggtcaaacaaagaggttacactatatttatcgagaaaaatgaacttaaacattagaggatgtaaaaaaaaagaatgtaaaaattgttcaaaaactaagatgagagtctttcaaaaactagtttagcagcagtcaataagttcacatgataatatcaatggaaaaaacaaagataaataaagagaacaaattgcatccagaaaccagacaatagtactattaaatattagattttaaagaacaactagaacaatacttactaaccagagacgaagcacaaaatgaattcacttcttatgatgacaatataaatcataagcaataagcaattaaaattgaaaaaaaaaatagtataaccaagataaaggataaaagatttactgactttatttccttgtagaacatcacggacttcttgagggatgaataatctactccgttttccaggttctcgagctgattccatgcgaacgacttctcttcccatatctcgcactaaatcgtgcatctccaaaatattccaagacctttggagcaagtgtttttggactaaagttgcaattgcacttttagcatgaaagccacatgcatttaccatttcagtaacttcatgctcataaaacccatggaaggcgcatgcaatatcgaggaaaacagtttgtgtttcatcatcaagtccatcaaagcttatcttgagaatcttttggatatcacaatgaggaattgattttagtttttcgaattcatatccccattcttctatagaacttccttgtaaatgtgaccccaatgtcacaagagctaatggtagcctacctgaatatctgattatgtctcgtgccaaattaacataatcttctggtggaaaatgactatcaaaagcatgccaacaaaaaagtaacatagcttcattgtcatttaatagtttggcctcacatctctctttttctccaaatcgacatagcaatcgcttgtctcgggtggtagtgattattaaactacccgaaccaaaccaacttctttctcttgttaaggattctaattggtttctgtggtcaacgtcatcgagaataattagaaccttctttgactcgagtcttgctttgattaaattgatgccttgagcgacactgccaactttgatgtccttatttttgagtacttgttgaagaagtttctcttgtagcttgacaagaccaaattcttcagcttctgatctaacatccgaaaggaagcaactactgtcgaagagtcgaaacatttgattgtagatagcttttgctagagttgttttccctatgcctccaactccgtgaataccaatcatgcgaactccatcttcacattcattttgcaataacaactctatatctttgacacgagaatctactccaactgggtgccaagcaacatctagaggtgtctggttaacctcttgtaggacttgctgtataattttttcaataaactttgattcatgcctacaaaatttttagcaaaaacaaaaaattaaaagaagaactactccggtaaataaaactttgatattagaaaatatttgatgggcaaatcaaaatcgatagccaagacataacccagtgggatgaatctaagcaacaaaacagataacttacagcgtcatatagtatactttaagaaataatttaagttatatatattgatagtgaaaatatttcgatactgtcaaggtatagtatcacatcctataaactctcttgatcagttagtatcacatcttataaacaattgaacaaataacaaatgaaaacatatagttgaatcaagaaaatgtacccgtcagcaacattttgcaaatcccatccagataaatttgcagcttcagtaagtgcagctctccatttctccaccctttgagctccaaatggccgttccttatgttttgccaaagcttcaccaaataacccaatttgctttcgtacctcagacggatcaacatcatagaaaataggcaaaaccatctgctttagtttctctttgcattcaagaattttaactagttcatttagacaccaactagaggaagcataatttcttgagaaaacaataatggaaattcttgacccttcaattgctttctctagtttacttgaaatcacgtcaccctttctcaattcctcatcgtcaataaaggtattaattccaacatcacacaatttggaataaagatgacccgtgaatgtttttcgggtgtcttcccctcgaaagctgaggaatacatcataagagaagtgagaagatgtagatgattctcctcgaactaattgagtatccatttgatgaattaaggattgatgagaatgaaagaattaagggattattttttagtaaatcgttagaacgaaaacacagaatctaatccatgaccgtctcctccatattccttcctccttcacttcttcttccttcaccttccaattatggcaactctgcaaaaattcaagctattagcgacccaatgtgctgtagcagcaggaagcccaactcgaagcccaacaactagcccagtcattcattcgcatgctcctcacccgcagcggcaacgccggcagcgacggaggaagtgattgacggctattgtccgaggacgatgcgtcgcaggatcggattttcagcgacggagattcaccggaagggggtgtgagaaataagcttaaggatttgttcgtttcttcgccggaaaattcgagagagggattttcaccggaaatttctagttccggggggatgatattttagtaaagtcctttggaaggaagttttccttgatatttcttagactttgtggttggaaacttaattcttgtacatatttcatagattccgaagatatttctagatggagtatcttttttgtacaaaatttttggtcttatagtgtaaataaatttcacactttaatccatacggtatatttacgaaagttaaaatgaatcgaatcgaattaatttaaaatggatcaaattgacgaaatttaaacccaaattcaatctcgtaactagtggtcgatttgtattaaaaacagtgacacatttaaccatcaaattctgaatccacttttgaatttgcagatcatacataacccttgagtgtattttcttgtagagtggtataataagaattttgcaaattcctttcaaaattttaggaaatttaatcaaataagattaaacaagagcttacggaagtataaattgcattatagttcacgttttttgaagtgttctaggaaattacttttgggtttttttcatattgatagtatatacaacttgccttgatagaaattgagtagaaatactcgacaagttgttttcgggattctcttcttttgcatctcaaaagtttttttctttgaatcgccttcacattatcggcaagtgaattgaaagaactagtcaaaattcatttatttcatccgtcttaacttatgtgatggtacttttacaaacatgaaattttaaaaaaaataataatttaaaacatatgatataaaacaagtcaatagtcaatagagtagtaataatttccgtcaaaatagcatggcgtagccacttttacggctggctatcgaaaaatagccaccgtttaccaagtcaatgaaaaatagccactattttgctgcacagggaccggtcccgtataatatacgggagttctagtgcatttttgtacgaactccagcttattttactggaccggcataaattgccaactcctataaaatatacgggagactggagcacccgtgctctaaactccagtatattatactggacaattatactgctggaactccattatattatgctggagttctagtgtacttatgctggaactccatcataatatgatggagttccagcatacttatcctggaactccagtataatatgctggagttcgagcatacttatgctggaactccagtataatatactagcgtatttttgagttttgaacagtgttttcgctcagatttatctttacataaaaagtggctatattttgatgacttttaaaacgcggctatttttcaatgaccagtgctaaatctggctatttttaaatttctcgcaataattacgtgtcaaatttaaatttctagttttcagagcattttgtttcaatattgtgtctacttttctttttaaaagaaagttttctaaaatactgatctatacttatagtcttttacattactagttcttccattaaaaattaataagttgggactcatttttattgtttatcaatgtattgaaatatcatcgcggtattttaatgtgagaccagttcctatatttaatttaaacctatttgatttgaactttggggttttaggtatcgaaatcgaatgaaactctttaaatatgaagcgaagtgtaacacactttattttttagcttgtttaaaaaatattattatttttttatatgtaaaaaaaattgattgttaaaatagtcatttaatcttaacgagataatttatagtcgcaccaatgtctaatgcttattttagaccgtatatgttaaaagtcttgttaagctctatgtctagttaaacaatattatataaattaggaccgaagaagtattatttttatgtcaagtcatttacaaccctacaaaagggtcaacggaaagaaaacaaaagtctccctagatatttcttaggtagttcctcttttgcataaacataatatatatatatatatatatatatattaggccactacaaattgaaatattcataaatttaattgaataaaattaaacaagagcttcctgaagtgggagtataaatgcagtacaatttatgattgtgattctttctaagaaattacttaagggttcatcaaaagtcaatttgtcattcaatatattgtaggggaaaattgatagaaattaagtggaaatattcaatttttcttcttcttttttttctttttgaaattttcgacattcaacattcaaagaatgaagacatttattactagtgaattatgaaataatctatgccctacaatgtgtttgatggtgatatcttgtggtttccaaatcttatctttagggctgaaaaactaataaaaggatggagaaaaaaatagtttttgaaaaatcttggtaaggtatgactgtcaaagaactattgaacatgatatttgacaaaggaatatgcttctaaatggacaagaagcaaacatgggaagcaaaaaagttgtttagtcaattactatacatgtgtttaatgtcttgatataaataaataaataaattgtatttttttatgacaaagtttatttttagatttttgttgattaatataataatgtggtttccaaatcttatctttagggcacaattctgtcagttcacttgccaaccatatgaaagatactaaaaaaaagacttaaagcaatccccacaaacgactatgagcctttcccttaatttttatgtcttacaatgcattggatgctctaatgtcttatcaacacaaagacatcaaaattggactatctttgagcaatcataattcttgaattatgcttttatagggttaattaaataagctctctttttttatttttcaacaataaaaaagatacaatcagtgccaccaacactataataagggcaacagagtactgtgttttgaaagacagcaagcagcctaaggtcaagcaccagcaaatgctcaaatggtggcctccaccaagggactactttaagctcaacacaaatggtgctgcaaagaataatccaggacttggaagcataggaggagtcttcagaaaccataatggggaatggatcctaagctacatggaaaacatccccttcaccacaaacataggagtagaactcagggttattgttaaaggactgcagctgggagagcagaaaaacctactgccactggagattaacattgattcagctgaaaccattaacatgctaataaatggaaacctaacgtttgatcatttaatttatgaatgcaagttgttgattcagaggatgggaagagtagtggtgaagcatgccttcagggagcaaaatagggtggctgatttactagcaaaacaagcagctggagaagattttttgtgtaaatccttatcactagcagttcccccggtgtttgccaatgatgtattttgggcagacaccctaggaactgaactatctagatcttttttgggttgtaatttaaacactatcatgcaaaacattgcatcactaggggatctaaaatatcccacaaattgcaacgacagtgtatgggtagctccctttagctaactttatataactcgtccagtttacccaaaaaaaaaattatgatcttttttggtgtccccaaaatttctaaactttgttattttgttcccttttttgcgcaatttgagtcttttctagcatgaattagataacgacatgatatgaaatgtcatgaagtgcatcaaaattcatttaaaactatatgtgtgatcatttcaagtaatatttaagctcgcttgctttttggaaatgatgtgattcttcgagttaacaaagaaccaaccgaccaggatcaagatcttgaaacgaaaacgtggtttgtggaccggtttcaagaaacagcgtatctcaagttttaggactcggaatctgatgattcaaaaacgaggtgaaagatgacgatctgaactataagaaagactatttactcgttcaaaataagtaaatatggatgatgtaacggttcaaggaagttatgatcttatgatattaaataaacgaatttagatcaagaaacgtgttcttgaatgatcaagaactataagattcctaaagtcaccacttagaatcaattaacatgataaagaaacaccacacgcaattgaaaacaagataaagactatcaccaccttgcttggaaccaaaaacaaggataaagaagacaaaatagagaaaaacactctattgtaaaactagggcaagcctcaaaaacgtgaattctctctacaaagtcatgagaaccctttatataggcccagggtctctactttgatgactacaattcctattctaataaggaaataaaataactaaagacaaggaaagtaaaatccttattctacaaggaaaagaaactagaatcctactaaaaggaaaaaccttattctaaaaggaataacataatcctattttaagaaggaatcaatcttggcttcttgaaatcaatcgtgagcttcttgaacttcttgcgcttcttgaaattaagtccatctatttggacttgagctctaaagcatgatcttggctaaatttaatgaaatttaacatagattcttcttttacatcattctcccctggttgagaaagactcgtcctcgagtctagaggctccacaaatggcacaagattggaaactttcatgatttggttgaaatgatattcaccaggctctaagttgcatttttctaacttgtcaaaaacctttatcgtgttgtaacaaagcttaacatatggccgaactaaatcccactttctcaatagtaactttgtaccaatattttcacaatgaatccgcttaaatcgatttttaaacgctaactcataactgtaagttattttcttttgatcttcaagaatcttgtacatctccatgtcaatgtggtgcttatgggatatggctgaaaaggtcgatttagaacaacaaaaccccgtagaagagtcaaattcaagtacctttggatctatcttaaaaatccaaatatattttcttgagaattcttcagcaacaacgctctcatatttaattagatcatatccatttatggaataaatttttgagatctcctgtaccaacatattcttgaaaatattcatcctttgggagcaagaaaaaaactggaacaaaatatgaactcaaaccctcagttatgaactcttttttaaacaaccctacctcttgtgtgtgcaaaatttcatggacatctggattaatgcaatatgttgccgcgtttggaaggatagaatcaacaatcaaattaatattatgttgagcacctctattaggtgaaaatttaagctcacatatgggatgctccaacggatcatcatcaaacttcgtaggtaaatcctcaacttgtagatccagttcatgctcctcctccttgattggactgacgttcaaagaattttctctattgattggaccaattatttgtaatttggtcaaaaaagaatcatcgttgaactttagatttttagcaatttcttcgtgattcaacgacactaaaataatcttacgtccatcctctataaaagaataggtattaaggtcttcatcatatttagcacacctatcatacacccatggtcttccaagtaataagtggcaagcatccatatttactacgtcacaccaaatcttgtccttatagatcgtaccaatagaaaaagatactaggcattgacgagttacctgtaaaacatcatcttgaacttcgatgctgtaaggatatggatgcaattttgttgacaaactaagtttaataaccatctcctcagaaataatatttatgtgactcccacgatcaataatcaacgaacaaacttttccatgggaggtacatctagtgtggaaaagagatttatattgtctcgtttcttcatcttgttgaaccaagaatcttccttttggttgaatcttagacatgttgatttctcaacctttggaatgtgggttatagctctgataccaaattgatgtgattcttcgagttaataaagaaccaacagaccaggatcaagatcttgaaacgaaaacgtggtttgtgggccggtttcaagaaacagcgtatctcaagttttaggactcgaaatctgatgattcaaaaacgaggtgaaagatgacgatctgaactataagaaagactatttactcgttcaaaataagtaaatatggatgatgtaacggttcaaggaagttatgatcttatgatattaaataaacgaatttagatcaagaaacgtgttcttgaatgatcaagaactataagattcctaaagtcaccacttagaatcaattaacgtgataaagaaacaccacacgcaattgaaaacaagataaagactatcaccaccttgcttggaaccaaaaacaaggataaagaagacaaaatagagaaaaacactctattgtaaaactagggcaagcctcaaaaacgtgaattctctctacaaagtcatgagaaccctttatataggcccagggtctctactttgatgactacaattcctattctaataaggaaataaaataactaaagacaaggaaagtaaaatccttattctacaaggaaaagaaactagaatcctactaaaaggaaaaaccttattctaaatggaataacataatcctattttaagaaggaatcaatcttggcttcttgaaatcaatcttgagcttcttgaacttcttgcgcttcttgaaattaagttcatctatttggacttgagctctaaagcatgatcttggctaaatttaatgaaatttaacatagattcttcttttacatcaggaaactatatttttttttctgaaatttagccgcaactctgtttttactcaaatttaacattctagacaaaaagaaaatcaaataaatgagaaaaataaagaagaaaaatatacagttggaacaaataatcattgtatatgaccaattgaacatgattaaactcaacttacaaagaacgtaccttccttccttataaagaggatatttggctaagcttataagctgctcaaactggcttatgagcattttttggtttatctacgcgtttggtaaataccgaaagtgcttataagccagatacttataagcttaaatcagccataagtcataagctgggcaccatcagcctatgactttttagcttataagcactttagtttgaccaagttttttactagtttatccttaataatattttttatttcacaaaatattttttccaaaataaattttctaactttcttttcatttcatatttgttcttcatctttttctttacaaagaaactttttaatttattgtcacgacccaaaccccgctccggtcgtgatacgcctctcgtgaagacaaggccagccaaaccattacaaaacacctcttttaagcagttaaacagttcataagcagtttaaatatgatttaatgatattaattagcggaagtacaacccaacacagccctaatcggggtgtcacaagtcacgagcatctattagagtgtgaatacagttctacaaggtctaaaaatacgcggaatatgaataatgaacaaaagagagagaagcggtgttgtgaacgctggcagtcacctcgctaaagtcctacagctctgcctccaatcagccaaaacccgctaccggatgagtaaatacctgcatcggcacacgaggtgcagggagtaaagtgagtactccaactcagtgagtaataaaggtaaataataactgagcagtaagaaatcacgtaaagcaaccaacatgttgtataaaagcagtgtacagtcctttgagaaaaacagtgaagttgtgaaatctttagaaacatcttggctccgtttaaacctcttttgaaaatgatcttttcaacagttacgtaacgatttcaaaatagttagtgccgataagcacagaaaatccgcccctcggcacaaaaccacaatataacaggtaaaaagacaagtaagtatgcaagatgaacacataaaagttcgcccctcgagcaatatctcaaaacagtaccggcccctcaggctcactctcagaacactctcagcccctcgggctctctctctcagatcactctcataatagtatcatataataaccgttgcggcgtgcagctcgatccacatctcgttgcggcgtgtagcccgatccatatctcgttgcggagtgcagcccgatccatatatcgtcgacgatgcactgggggtgtgcagactccaggaagggccccttacggtccaagcgcaatatcaagccacctcgtgacatcatcactcagcactcggcctcacgtcacccgtcactcgacctcacatcactcaagccacctcgtggcttctaaagtatctcaagccctcggcctcataccactcaacatatcctacatatggccctcggcctcactcagtccgaaaatcatcacaagcccgtcgggcattagtaaaacagtagatatcaataggactgagttcaagtaataagtcaaaacagtgaggaaacagtgttagaaatccccgaagggttcaaataattggcacgaagcccaaatatggcgatcagcccaagtcatgatgataacaaataagtttcagtcaaatatgcggtaaaatcatcaatcgggacggaccaagtcacaatccccaatagaaaacaaccccacgctcatcatctggcgcgtgtctcacctcaatatagcactacgatgtgcaatccggagtttcaaactctcaggacgtcatttacaatcttgaatagcttattaataagctgaaaaaaagattattacctagattactgtggaaatctgaaagtgcaattgtgatgcacgtaagtttacagggtaacaaacaaattaatatgctcctacatatctttttttttccctttgagtaattaattattcaatggaaattttgggcaaatctattttctataaaagcaacataaactttaatctattgtttcattcttacacatatgcagaatattgaccaagaagagttgtggcgagaaggataaaatccttccttccttaaccaaaagtcctggtttcgaaccataagtatagaaaaaattccgatagggagcgcttcccccttttagatagtctttacgctacattagtcaaagcccaaatacagataacctccccaacataaagcattattcgagttggtacaatgatttgaagaacagcatatgttcctacttctacaaaatgataacaaatttatgaggaaaatcaaaatcataatacaagaattctacaaggattaaagaacatcgctttagaaatcgcggaaactcattttaggatcttgtttgttgttgccccgtcctcttcctcgataacctccccttccttttcctctacctcgtcctctccttccatgcctagaaaacgatcttccatgtttcatttccacgagtgaatgcagcagctcgtcgcagagaatacatcccttgtggagcgtcgctccatcttttaagggagttgttttcttgttgaaatcgacttctatgatagttgagtcgcattcaggacacttatcctgagttgtagagatccgatgagcgccttcgggcaaggaaacaaggcaattgcacatgttgcagtaaagcctccatttgggagcactgacgggatcaagaacaagtgtaccgctgcattctgggcaagcacaaacgccttgtgcaatcacggaatgcggacatgtggggtgtggacagaggaaacaaggcattccaactcccttccccaacttggaagaatcaccagttttaggagcaccaaaaaatgtatcgatgccttcaaacgggggacagttgtagcaataaggacacagagggaatgacttgccttctggacctggcatgctacataataacagctcgaaattatccagggggcaagtaagctccttgtacagctgacaaaaagtaaaagaagttttatatttagtcgtaaaatttgagcttaagtcatacaataagcgctaattgaaagaaaactctttctgtgaaagaatgttacaagggtaattctcgaaaacaaagggaacacagacaaaagttatagctcactggggtttggcacgacaagtcaaataaaatgaagttatttactcgatgcatcatgaagctaaatatttttctttccgcagcaagagatgaggccaagacagtctattatcgcaatttgcaagaatatctctctctatatatatatgaatgcggacaagaaaactaattcatcgacttaccaaaactaaaaagaaaaacggtacaatcgttaagttctattattgagatgaataagcatgataaaagatttgtaccatatgatataaattgactgattgagatactgccaacttctcgaatttcaccatacaagggcataattaatacttagtttttcctttctaagtttagtagggttgaaagcaactttagaacaataaatatttaccttgactgttcccttctgaggtacgtaataaacttcctcacatgtaccacagtacaatcgagatggctgagtagatatgtatttcatataccgcaagcatttgccacatttgctaaggagacgtccagagtcagatagtggcgagaattgtgcttcaaataatgcatccatattttcaatctacatgaagccagacacgaggctcggtggataattagcattagataataacaactagagaatttttaggctgaagatgagtgaaaagggggataaagtgcaaaccatgcttcagaacctttttaccctcacttctaagctagattctaatgtcaatagcagtaattatccagattttgacttaagactgttaagtgttacttccacttaatttttaaaaggaactttcttatgcccaaagcactcatttctaagcatctgtgtgatatttcatgtccagtaacttttcagaaaaaacagtaataggaaccagcagggaatatccacaactgcgaggtgatatttgcatcgctagttttaaaagaggtacttgggagctcatgattaagttttttctttcttgataagtatgattaagttgtttatcagcttgttacagagtcagggaagaaagaaagcatcatcagctatttgtgaacatcagcttgttacgagtttgggaataatgaaagcggcatcaaccatcatttaagagagatcatgtaaaaccactttccatggcagcagaggggatgtagcttaatatcttatacctgcttaacaaaataactgaacttccttcggaattgatctagtacatgctgcacaaccattgaatgatctgcttgacctttagctactaaagtgatctgatgctcaatgaaacttcgtatgtcaggcaaacagagatcagaatctatgcattggtaccctcttatcaagctgatgcccagaggagttggaaccaatcttcgcccagcttgtacctgcaattcgaattggccaaactcagacacctaatttctaatagaagatggtttcatgtcaaaggaaccataactgaaagcaacagagaggaccacctacagcagccagaaatggaaaacaatgcatatagcaaaacctggacatagttgcgttcgcatatgttgttaatatgtacggagattgacgcatctgttccaataccatgtttctccatcaaagagatcagctcactttcgttgaggtaatctggaggcgaagtgttcccctaaaagtttcaaagcaaaaccaaccaaagtaaaacgaagctgaaatgggaaacccctcaccatatgcacgtaattgtcgtaaaatataggacattgtacattctgaatataaatactgaacctacaggggcattcattatggacgacaagcttcggaaatacgatttcagcaaaaaacacttggactatttctattgccaatacaacgtgtttagtcaaatatttctattagttaatacaacatgtttagtcaatttctagcagaagaaagaataaagtgtccagtaaaatggagcagaatggatactgagaactcagataacaaaccccaactagcctgggattgaagcatagttattgcctttttttttttcttgaaccaaaagaatcgataatgggacaataagtactactgaagtacaaagactgtcactttactccagagctgaacaacaaatgagaagttcaattcgacagattatgtgatacctcatctagatcaactttagaaatctcaattttctctccttcagcaaagtcaggaagattcttctcactaatagccagccatggcataatagaagtgaatcctttgactgtgacaagctgcccaatgcactgaaattgctctccaccactttcaaattcaacctttatcctgagaagatatcaaattgtatatatgacttaacttctcagccagaaattagaaatcttgaaagccaactagattaatagtcccaggatttgaactgtcagtaacagtcctctgccctttgcacgtattgtgctagtaacaagaaaaaaaatcacctaaaagcaagatttgaatctgaatctataatatgaagacataaaagagctgcttgacatgatctaggaagaaaacatgattagagttacccaaagtcgtggattagttaaaaggatatgtaagataagcccaaagcaagaggagttacggatacgtccatcaagagataaaaattcaaccttctatatttgcaatcgggagagagagttcccagaaaatgctggcagatgtactggtacagtttccatgcatcattccccaaactatcctcactagctgaacgcattggagttattggaggatgatcacctgcatcagttcctgcccgtggcttaatataactttcagttaaaagcttttgcgcataacccccaaatacaggattatgcaccaatgctaccagtgttcctctgaagtcaaacgaagaaggatatgctgtgctctctgtacgtggatagctgaagtaacgaaaaagaagaaataagccaaaaagaaaaaggatgatcgtgtaaactgcattggaagttcatgaagtacaatgtttcataatgtcaaactcgtatatgagcttaatattacatgcaaaatcgcacaagaattcactgaaaggaaactggatatttgaatttccaaatagggaattgaacaagttcggtataaaaataaaacgaagtgtaaatgtgcactatttaattcatcaacaaagggcaaatgagcactgctttgtacctctctgattgttaatttttaattctctctataaaggattgcacccccttggtgagttttctctttaccatttaaaaatcattttaacatcaccaaaattttcttttatcattcaaagctgaggttttgttaataaaaagaacacaagaaaacgtgcaccaagctagtgcaaaaagatgacgaaaacatgtgaaaagaattttctctggcaagaagacaaaaagtaccctctcttcattagtccaataaggaaagaagtataatatgtgaagattgcaagagagcaagacaagaatgcagacaaatgaaccatatcgatgttctgagatagaccaaaaccccaccattttatgaaaagtaagattagcactttcatcagtttcataggtacactggtgatacagcaaaggtattatatacttttagtgcagtattgaactttaaaccgacattagtgcattatggaactcaatcactcagtattaatacaacataagcgaagttaagtgagcaagtaatcccatatgtgcatattcttgtatccagaagaaaaaacaaattctaaaattttctctagcgagaaacttgaggggaaaatattgaacgcaaaagtgcaataatgtgagagaagaacacaacagtcagaaaacagagaggaaaacctgataaaaccttgagtatacagacgctcagccaattgcatagtcaactgaggaccgaagcctagtgcacttgaagctacctggaatttgtcaaaaatcagaaccagaaggtttaaattcaaagtaagtgtaagaaaaatacatttaaatcataaaaaggatcatgtaaagtctaacgggttcagagttgtattgactcaagtacaaagttttagaaagattacaaaacatggacaccatacacatgaaaatccaaagatggaacttcgtttcttgaacacataaagagctctaattacttgaaagtctagagcagagaagatggcaacatcagcaacatcacaaacaatgactccaggtagaaacagttttagattacacattctccataattgcattaaaaggaaacatatctacattcacctggcagttacaatgctaatcaaacagaaagaaatttaaaggtgtaggtgtaggtgtagaccgcttcaaatgcatagacgattaattagcatgaagtgattgagatgcttcttaagatatgaattttgacaggtcaagactcataaaaacattaagcataggcacacatttaaaaagagttgcttgcaatccacacccttgacaagttggcttctttgtgcaaattatccagtattttaacaaatatgaaaccccaatatccaataaagaatctcttgggccacagtaagccaccttgtagctaatgatagcgggctagataacacgttgctggtgccaaaagtggaaagagcagcaaataaaagtaagcacatgcatttcattttcagaaaagccaagatagctagcaccacatctgaaggtatgtaactggtgaattttttgagtaccaaagactactttggcataacttatttctatatatttggttcaacaagtccagaaaaaatcttggttgacttctttcttgacaacttttaagcatgtaaacgcttcctaccttgttaatagcgtgttttgatgaataaaatacatcaatgaggaaatctatccaaggcaatttgtttcctttcggtataccaaaaacaaagccagaaatctacatatatctcaataaaatggaagcccaagtataaaaattggtaaaaagcctaaattaccaaccttcagaagatttactgtgtttagaccagaaggacgacctttagattccagcttttctgataaacgaacaactctcataatcccgtcctccattagtctgttacgaaacattgcagcaacctatcaattgacaaggtattagcaacagaggcatggacttgatagcttgggacaaaacctctcagaaggtcaaacaggaggaacttacatcagcatcaaacaaccttccacgttcccattctaatttgagttcataccccttgtacattatgtatggatgcagcatccaaaacttttctggcttgaacatagtgatttgcaggtaacgatccacacagaatccaagtgtaggagtttgacatggcccgtagctgaaattataaagcatttcatttagaaaggagataattttgaaatataatgctaaggagtagtttgtagaagaaaagaaaattgacatgtaaaagcaacttctcatggtggttgacattagtacgaaaggtgaaactgacagacttgtggagcagacaaattgatacagcataagaaagttgacgaattgctatataatagcaagtcataactcataaagaacaaggttgtttttaatagaacttatataccagtatgatttagtacaattgaaaagtagacagagaagtgcaacaaccacagaaacataaggggttaaatttcatgaatggtcactcaactttcattttaatacaccaaagttactaacttttttttgtaacggaaaaggcattcacctttgcctagtatcacacaggaagtcattaaatttttgtaataaaagaaccactcgactttgctactaatgactagtgacttcaccactcgacttataatcacgcacaagaaggaggtgcaaccactagtgactttctatgatatttaagcaaaattgagagacatttttgttgccgaaaatttaacgactttttgtgataattaaagttgagtaactatttcgttacaaaaactaatctagtgattttggtgcaagaaagtgaaagttgaatgaccatccatgtcattaacccaaaagataaagggaaataaagtcaaaagccagataatcatgcaatctaaataatcaacagataaaccaaaataatacaatgtgggagctcttctgtgacgcatggaagaaagtttgccatttgaaaggatataacatgttaagaccgcacaatcagcatagagcagaagttacagctgctacgatgataggcaaagcatttatgattatgataagtaatttctcctaatcagacactaaaagttcagttaaaagaataaaggtgcaacgtgctaggcaaacagtaggaagaaggtggcgagagaaccaacgagataacccttgcatcaagatttccatatttcccgttgaaatagctagtctggaaacgtgtaaatgcaactccaactttcaaatcaatctcttgacgtgcatctactgccaatgcctcatctctgttgggttcaacaaggctgtccattgccttcagaatatctttttcagtaacagatgagaatcgagcgcggtatattcttctaccatcgcttgtgtgaaatccagtgcactctatgactaaaccaataagtataaaagaaagaagaaagattatgataaataaaattttaaaaataaaagaactaaagcaacctaacaaagattcaaaaggtgaattattggaagttctatcaagtgatatcggtgcagagtgaagttcatcagtttttgtacaaatagacatatatactcatatcgtagaatatttggcggttttatttggcattctgaataagagtgattcaaactagagtgtgattgcctattctgcttcctctcactatctctaaataccacttactaactgctataattcaactctgctacagaagcacattccacctagtctcgcaatctgtactttttctcttacttctttctacttctttccgcttcccagtctgtctttgcctttaaatatctaccatatcagttgagcaaacgatgtttaagtctctaaattctcattctcagctcattcctctgaggaatgggcatgagcttgacacgtttatccctagcctagtcaatctatgagcttctccattgtagtacgtccttagctgcagttaaataataatgtcaagatcaaacattaccttcaaagcatatattttctccttcacgatcacaatccaaccatagtaccagatgtgaacaaccacgagcttcctggcttagatgcctacaaatatgagccttgtatccggagggtcagtcagcacttgctatttaaacatgaaaacaaataaaaatccagatcaacagaacaagatgcaagagaaacttacttaatagagttaattctagcaaattgactttatatttgacagatactatgtacacaatttctcgaaccagataaacttctggcaaataaagagacgaatcctacactgtctctcccttgtgtcaagattttcagtggctattaagactacattaacgattgtctacttctaatgaaagcgatttgagtttcagtcaagggcacgttgatcaacctcttcattctccgtaagtagttcaacaacgattttgttaaggtatcaaatttcttcccagttctattgccccaagtaagaaagagccctgagtaagaacacaacataaccctcataaaagttgtaaaggactttttagttgagaaattagcacaagttttaagttcaaacaaatatgtcaagacgtatcaatgacccaattttgttacaggataattggtaaaaaagatacttttatatccacttttatttttatgatcccagcatttctggaagtgaaagagagacaaatttcactaacacggagcaatttacaatacttgaaacaaaggtagcgaggctgtatagagatagccaaaaatatgataaaagccattaaaagggaaaaatcactgtaactttaatatataggaacaaggataagtaccacctttgggtttgattccttcttaagtatcggtgcctggaaaagatctgaaggatttgtatttgcccaatcttgaaaagcggctggaaaatctacactagattatcagaaacagaacattcagattgaatacttgaactaaccaagtaattgtggctttaaatataaagcaaagaattgctggcagatcaagcaatggactcactgtaccacttgtttgaaactataacacaacatacaggacaaagaaaagttttcaaacatataccacaatgaaaatcttacagtatgcagagataatgaagtaattttgctcccagctaagataaagccatatgacaaaaatatctcacttgaaaatcctaggataacgctctaaatgatcccttttctttggtacgtcatgtgtacttcctcttttgctgtaattccgaatgctccatcgaggtcttatcgacaagaagcaagatgaacatgttacacgtcgaatattattactttttttataacgtgtattttacttggtagacagtcattctggttattcattagaataaactattaaaggctaaatctataaagcaactaagagggcaagcgaacaggctacgtaatatctacgaggttaggcaatacaaagccacaaggacacattgttagcactctattctccatggttctatatctacatctgactcctaattgaggagccaaaaggggtggcatcacgaaaaggaataactaagcattttctttccttgaacaacagaaatttccaagagtatcatttttgtggttacctcaacattattttgaattgcttctatatatattaccattcactgaaacagaaggtgccacttcagcaatgcatactagttttttatagttgacagtgtgtttcgtttttcaaaaggtaatgcttcacaaagaccaatgagtagcagtcagtcgtagacagaggcagatttgaacttggaatattcattttgaatcaaccaataaactatacctcaattccaaactatctatatgaatcctccatatccattctgctatttgggcccatttcatctgtcgtgtagctcatgcataggatagcacatcctaatgaattttattttcaaatgattcatcaactttacattcaactacctcaaagaggctctcaactacctcaaaagagggtatttccagaagaggatacaggctctcattgcggctaacttgatcaattttgcctcaccaaaaagcaggctcaaacatcttttttagttggggcaggagctcaagggaaatgaagtgaccaaacatcaaactagaaaaattgaacaaagccaccaaaatatcaacggggaacataacagtatggacatcgattgaacaaacatattataagcagcaactaattgagccaaataacacatcaaaacgaacgattcttatgttctgggataacaggaaacctgaaaacatgaccaattactgaagttactctataatgtgcacgtgatccaagaaacatcccatcaaactcatggacttctgtacttgcccttcgtgttgacatctgtgacaaaatgtataacagaaccgtatgaacacctgaagtccatgatttaatgaaggaagataaattagccgctggtgtcaagctaaaagattttcacagaagaaaacagtgaaaggaacaagacttaatttggtaagagcatacttctatttcaagaatgttaacagcccaccaaaggcaacgagggaagccaaccagcaagggtaaaagcatacttctatctcaccacatttacacgaagtacaagaatctgaagcatcatatccaccaaattggtgctttcggaagagaataacaacatgaaaataaggaggaatctaataaactgaaagctgaagactaatcaggagggcactgaaaacaaacctaccgtgtgcattgaaatggagccaatcacactagacaattggaagttgttgacagtccacaaaacatgttagaaaactataatatatattattagaaactcagcatgactcttgcgaatcctattaagattgataaaagtgagggggtcagttcctgaaaaaggtagcatgcacaatcttttcggacttgtaaacaacatgaaagatgccacaactccaccaatgcagtagttcttgttgttaaagtagaccgtgagccgagcaccattaccaattcttctctctaataaaaacattgtagttgatgcctgagtaaatcattaaaatccattttcatatcattcatttgatacttttaaccaaatgttgcaagcatcctctttccttgttctttgttcttttccttacaagtactttcccttagtcttcttagtcccttagaaaacaagaatagtgactatttcacttgcaacaaatcctaccccccccccccccccccccaaaaaaaatccttacttgtccaatctgaaatttgagataatcacattcctaccagttgatacattaaagtgttgcaaatagtaaagggttaaaatgcctaaggaaaagaatggcaataatttagctgtaacttcttctttaaaatgttttccttcacttcaatcaaccaaaatattttataattttgcatttaatcttggattgaaaacaaaacaataactaagcataccacattcagcataaaaacagctatgaatatccaacaactaacaagcaatcagtggcggacgcacgttggtggcaaaaaaaatattgtgtatatgtataaattacgattaaagctgcgtaaattttgtataaatattttatttcaacccactcgacaactactattttacgaataaaattatgtacttttaagattgaaccagcttgcaggcccgccgctgcaagcaataggaaaagtgtaaaaaaacattttttatggaaaaaatcatatcagtttttccaagaagcagaaaattgatccaagactaacataagatttcaaaaagaagaaaaaaaaacaaaaataaaaatcagacccagaaaaagagacaggaacatatacttgagcaccagataaaactgaggcaattgataaagcaatactaggcttctctgctacctgtaaatgtaaaattccccaaatactcagtcaagaatcttaaataaatggaattaaaaaaattaatagtaatgatgaatttaagggtacaataccataagaacttttggagccattttttacagcaaatatttctgaagcgaaagggtcctttttagtttttacattacgtagaatagaatgatagccgtagatctcaaaggagatatctgagccgtagctttcatctgcttagccaaaaacaaaaaacaaaaaattaaaataaaaatatatatatatatatctttattttggagaaaatggtccgacattagtcccttatgtttggacactagtgacaacgggccgtgctacgcccgggcccaatcttaatatgaaacagccgagtattttgtatacaagaatgactaaatgaagaattttcgccaactaaaataataatgctattagggaagaaaaaagtaatgtgtacacatttactaattcatgatattttatgtatccttaagctaattgattaattacatgccatatatatttgaattcatatgtgtatggtgataaattgaatttcatttagcagcaaatgtttaacaaaaagagcatgaaaatcacagaaatacagtattttccctttgtagtgagcttcgaaaacctaaaggttttcatactgtgctatttgtttgctatataatttatgtacaagtaggtttccgagatgttaatagttacatgaagtgcatgaatattgtatatctaaattttaataattaccgattggttaattatgtgatcttttgggagttctttttatacataatattcaaagagcatttgaaatttattaaatccttagtgtatgacgaacataattatatgccttctaaggaaagttttcatacgcttacatctctcactttaggcttcccttttatgaaaatttcttattttgctattgttgtattttatttagaatataaactatattaatttcttaatatcagttttttatcagagctaaatattgaaaattatatgttatatttgttcttttactaagaagcatagcatatagaataaagttaaaattttaaaattatacatataaataatgtcttaaatgtttttcgtcatacagaatatatagaaaatgaaaagaatattatttcttgatttaaaatttctccttttttcttctaaaaatgcatgttaaattgctttttcaattattaacatgatgctacacaacgaaagagtaagagctgaaaaatatgacttacaaaagcactgtgttatattacttctgcaactataaattttattttcaaaatgttaagaaattatttgaatggatgttttaattcatataacatcaaaaataaagtattctaccattttctaaaactaaatgaaaaaaccaactaatgtcttgtccatttccacttttattttttaaaaattaatcatgaaattacttttaaatttatacaattctgttagaacatcttatcaattaaatttagtttaatataccaaacgattgggttcggaggatatatagtggcatatatagtaatacacatggtgatgaatcaacgatagcctcaacagaagctatgactaagcccacctttgaaaaagaaaaaccacaactagtatttgaaaggttgggtggagcccacgtttcgaaaagatgatccatatgtctctcggtatttgtgtcaactcacagaaaacttcaattactgttgcacaccgtacaatagcttaagcatgagctaagcagtattcttttagctaaatgtcgaagttgcccgttttgagcatacagcttatgctgacatgttgaccctaagctgctgaaactctcccttagtaatagtaggaatttattaaaaattttgcggagcactatgtatttcaaacttggtgattaaaatttggaaaatctatatctatatgtatatattaaagcaaagaagttaccatatataattgatattatgattaagccaagtggcaaactaataaatgtcagtagtatatggtaaatttattttatatttgactattttagttaaatacaaatataatataatataatataatataatataatataatataatataatataatataatataatataatataatataatataatataatacaatataatattttatatatatatatatatatatatatatatatatatatatatatatatatatatattcacgaaatttgaattaaaagataatttggaatttatagataaagttctaaaattcgaatttaaattaaaactaaaatttatctttttttatcatgttatcatacttaattcggttaataatcatatgtaatcatgttaggaacttttgttattttttttaattatttaaatactacttcgcaacaaaaaaaaactactccatataactataaaactctttcacatttaaaatcctataagtatagttctttgaaacactgtagctagatttgaataaaacgaaattcttttaaaataaatgtaatatatagggtacacatctatgtttatctaaataacaaaaaagagtttacaaaaccaaataaaggtttacttacatatataataaagtaaacatacatgctggagaaagaaacatcacaaaatcggtcaatattttttataaaaaaaaactgtttcttttttcttcttgaagaatatttgtttgtcaatttgcataaatggacatcaaataagtaacaaaactttggctatacaattgctatcactaattttaatttagcacattcaaagaattaaagggtataagctcaaacctcttcatttagctgtagtcgagccaatattgcaagggtgtaatatttttttcgttgaacaatattagttttgaattattagattatgtgaaaggttttttttcaaactcgacaatagagaaattgatttctaattgatagtttctatagcgggttttaagtgtaacaaagagtatatataaagaaaaaattggtatgacgtgaaacattttttttttaaaatgtaaacaaattattttaaaaaaactctttacttttttaatttaaagagaataaaaagataagatatttttgaacattagtagagagttttaaaattattataacagaagttatatcatggataaactcaaaaaatcgaaatcttatgaaatatttacataatatccggccatatttattatttacttttatagctaatataaaaatatgatataccgacaatacacgattatacacatattatatatgatttatacataaattacacatcattcaattttttaatttaagtggtcgggtgagcacctatttagggttattagataaaaccaaaagaaaaatatgaaataatttcaaccaaaaactaaaaatataattaaaattcatatgtagggtattaaatttttttgtatatatagggtattaaaaattcaaattctggggttagagatatcgataaacttaaagaggagtcatactgaaataaatccggccaaaatcatttaaatattcagatagccgattcaagtgaattttaaattataatatcttcacttgcattattataaagataatcaatatatatatatatatatatatatatatatatataaagttttaaaaattgaaatttcaaaatagaaatatttttttgaaagataaaatcataccaaataagagttcaagccgtactataagagttacatcgtaatcaaagaatcgtttatatcatgtcaacctttgtgctttgccataaatatgagttattatttcgctttgtggctatttttaggttccaatgatacctatgagaaaaacgcaaaaataaaattatcaatgcgagaattgagaaaatgttagtctttttccatgtagtgtttcttaattaatatctgacgattatctataattatttagaaggtttaaattttaaggttatttacatatatttcaaataactcagatatttaatatggttattgtcaaatatcaaaatggagtaaaataatcactagctaaagaattttttatatttttagatagtcaactaaagtgagttttgaattaagaataatattttcaattacattattataaaaataattattattgaaaaataatgttttagaaactgaaattttaagaaagaaatatttttaagagatatcaacacaccaaataagagttcaagtagtagtaaaagagttaagtcttatccaaagagtcattcattgtctcaacatttgattattttgccataaatatgagttattattttgattcctgactatgttaggatccaatgacaccggcaagaatgatatcaaaaaagaaaaatagaagaaatgattaatttttttccatgtagttaatatccaataattatctatatttattaaaaaagtgtaaattttaagattatttatatacaatccaaataacttaaatatttgacataattagtgtccgcgcatccgcgcgggtactaatactagtgatattttataggcgctttcaaaataatattcgaaaagatatatatatatatatatatatatatatatatatatatatatatatatatatatatatatatatatatattcactttttgcgactgctgaatataaataatttcttaagtggactaaaaatgataataccacacaaattttccccataacgtagtggtatataattttttgtgcccattttttgctttgttagaaaaataaactcatttgattttatgtacattgttgtttatatttttaccctttcattcttcttatgtttctagggatggcagtggggggcagggcggaagggttttgtttgatgcgaagcagggcgagtttattcctatacgggtgcgaggcgggacactgcgggttaaaataatttttaaaatttttaaaacgggacgggttgcgggtttaatgcgggttcaatgcggtacaactttgaatttttatcttttttgaaataaagtaatcatttcaaaaataatttcacattcttgttcactagtaggaatactattttgatttataattaaccaatttacatacgtctcaccagaatgatattacataaatcaagatatcgtattaataataggaaatgatagtaacccgtttattttggaagatcaacgcaatactctctcagttttatgtctatgtgattctattaaactctcaattttataaaataataaaaggtaaaacaagtttattttagaaaaaaattaaacaaaaaaagaaaaaaattaagtggggcggggtagggcgggttgaaaactgaaaaaataactatgggggacggggcgggttgaaattttgtgagttttgccaaacttgcccctcacccgccctattgacatccttaatgtttcattctccaactctttttttcaccaagaaaatcgaagttcttcaatttctgaggatttaattcttgtttagtgattggaattcgaagttaaccgttgactaaaattaaaattgtttgagtggtgattatttacgcttaaatttttagttcaaatattaatttagtgatttactctaagaatcttaaaagtttatttttggtccttagaaaatgttgaaaagacaaagtgatcttttgatctggtgttatttgactaagttggtaattaggggtgtgtttggtataacgaaaaatatttttcaagaaaatattttcttgaaaaataaatagtaatcttatttattttcggtatttgatacgtaaattaaggaaaatgacttttcaagagtattcataaataatttagatataataaacatgaagccataaactttcaaaccaacaaccttccggaccacaaatttcataaactttcgaaccactaaactttcattaccgcggaatttcgaacccgtaaacttccaaacacataaacctccgaactcataattttgaaacttgtaaaattttgagcctttaaaccgataaataataaaattaaaactgaaaaatatatttaaattttatttttttaaggaggggggctggggggtagtaaaacaaaaaaaaatagaaatttatattacaaaaaaaaaaatttattccgggggaggggaggtgggaagattggggtgggtggtgcagaaaaaaaaaatttaaattgcaaaaaaaaaagttaaggtaaaaaaaaaattgggggggaggggggatggaggggtagtagggtgggtggtaacggaaaaacttaaatttgaaaagaaaaaaagctttttttgtggagaggaggtggggtgggttggtgagggtggggaaggttgagaaggagctttggaaaatatattcccttctcttgataaggaaaatattctcctccaattagaggaaaatgaattgataaggaaaatattttccaaaaatttaagccaaccaaacatggaaaaattttaaaatatttttcgaaaaatattttccttcataccaaacacaccctaagagttttttatttggaggttggaggcttcatttcaaatttaagatcatttggaacatagttgggtggtttgatcgaaattaatattataaattcgaaaaatattttgttggactacacaaatagaatttgtcagtcggatagaatttcaaacaatttaactgagagaacaaatgcaacaaacataaagtcataccaattgtattgggtaaaatcggctacctacgaccttgaggtcgtaggcacgtccccctctctagagggacgtccacgacagggaacgtccccccagaagagcgacgctagtaaccacgacccactcacgacagagacggcctaaacaatcatgccgttgaaacgaagcagttcggcgacaagacttgtgacagctatgtgacagctatgttgcagactgacacctctgtgctctgaggccaccaaccattgtactttattttagtatatcgaggagggtctcctaggatataaaggagatctcttccttcttgtaaggtcagatgtatcttctgataaagaatatatacaactctctctctctgcatctttcttctgaataatcttccgagctctctaatacttaactcaattaaagttctcgatccgatttcacgatttatcattgttcatttttgtcattatctctagaaagcttattacctttgattccgatttacctctccttaataaatagtgattgttcttgagcttaaaggtcacgtatagacttttagccaaacaccaatcttgtagagagtttggtgaacaattgatcaaccataaagtccatcaatcatgtagaatttgtgagttatctaacaagatggctatgtggaatatcgcacaaattaagttatatcaacccggttgaacttgagaacaattgaaccaacacaaactcgtgacaatccgtttgagtttgtaagttatctagcaaaatagttagatcgaaaagtcaaggtgatgactccaatggaaaattgaaaatgaaagtgccatcaatcgtacatttttcctggacacacacccaataatatcttcgaaattttatttaagacctcttaaaactccatgaaagtgacataaagagtcaattccactaaacccccctaacctttaaaggttgggaaacaataccttcctcaccttttgaatggaaaagggaaccccttatgcaacaactttccggtcaaatattttttttaataaaagtcttttttttttggttataaattaattttttaataaaaatctttttttttgttataaaaatcttttccggtgaaataatttttttaataaaaatcttttccggtgaaataattatttttaataaaaatcttttcggtgaaaatacctccataatgaattttcaaatgtgacattattaactctaatttctgttcaataaaaatattttcaaaataagtaaagtttaataattattttagataataattttaatatacaaaaaaatacataaataaattaatacttacagcaacaattatttcatctaatatgtatgtaagacaattgactatttcaatgtatgttttcccttcaaattgaaatgctaaagcatccatccatggtgaatgtgtgtttaacatatttcttgaattttatgtgcaagatttttttacaagcaatcttaaattttacaagcaagataagatatcttacatatatattcaagaaatatttaaaattttcaagaaatcttgtaaaatttaagatattttcaacaaatcttgtaaaatttaagatattttttttttactatattgaggttatattgaagccattgttaaaattttacaataaataaaacttattttgaaaatatctttattggacaaaattatactccttagttgataatgtcacatttaaaaattcattacgaagatgctaattgaaatgctaaagcatccatggtgaatgtgcgtttaacatatttcttaaattttatgtgcaagattttttttttatttattgtaaaattttatgtgcgtttaagatttttattaaaaaaaattatttcaccggaaaagatttttataacaaaaaaaaaaagaaacgatttttatttaaaaaataatttataataaaaaaaaagatttttattaaaaaaaatatttgaccggaaagttgttgcacaaggggattccctttcccattcaagatgagggggtattgtttcccaacccttaaaggttacggggtttagtggaattgactctgacataaaagtccaaaatataatagtcttgagaatatatccttttacctccccatacagtagtcaatatgatcaataatatttatattcatgttcatatttatttcattaaacaaaaaaagacaaattttgcatgtttgtcaaaatgggggacaaacatttaaatacctgcgcaaaactgatatatttttcaaatcacccgaaaaatgttggccagagcccaaagctaataaacctgaattttcacttttagcccacgcctgaaactatttatatttgataactaaaaaagtgtataaaatttatataatttttttttatataatatacagaaagaaccaactcctcgtggtctggaaagccaaacttaatcttaagctcagctaagcgctcggccgttatcgtggattggaacttttttggtcaccactttcgatgatttttgaaaatcatgtttagcgtcagggtatcaaggtatagtctcctccacgaaggggagagtttcatcatcaatgggggagacaacatcttccacatgaacggggaatacgacagccaaaggaacaaaatgatcctccacactagtatcagatgaaaggtttgacatagctatgcataggggttgcaaaatggttcaaagaaaacagttaaccacccatattatccattaaaaaataggttggataatgaattatttaaaaatggatcaaatatggataagaaccatattatccatttagaaaatgggtaatccatgagtaactaatggataaccaatgggtctaacttttacatttgtaaagcatcaaattgggggttcctcaagttaggaagactaagaattcttccaaaagtgatcatatacaagaagttatggataagttacccatattatccgccggttaacccgtttttatccgtattaaatatcgatcgggtcggataattgatccgttttttcattatccgttttcgatccgaaccatatccgacccgacctgcccgtttgccactcctaactatgcagattaggaaggagatagactgatagagaaggaaatcagaaatacgaggaaaccttatgaaagaaggaaaggaaaaagaaaagtgaagatagcgtaaaaatttgaattttgacaaagcaatccttatttatagagtttaaagcaccaaaatcagaatggttcgccataattggattgtgaatcgaaacgacagagccaataagaaatcacgcgagaatcgatgcaatgcgtcgggaattaacgtcaatatgatacttgacatcatgacatcacattttttgttggactaaatggttccaacaaatcaccctaaaaattcgaggatttgaaatatgcgacccactaagagccatgtcacttgctcgtcacaacaaagacaaccaatgtcatctgttcagtgaactcgactacaaagacggccacgaacgatattatccgctcattgaactcgctatacggagacgacctcaacaagcagagggactaattatatgagccaaaaattatcctagctacatatggccaagtcaacattaggagagcctttgaaggctgccacacgtcaccgatgttatttcaacaaaggatgaaggcgaagtcgaggagtcaacatacatatgtcttggtcgaggacgagcgctctccttaacggagcagtaacaactagttttagaaataagactttagaaagaatattctaataaatattcgtggaatctatacaattgtggtccatgttctcttatctatatctatatctatatctatatctatctatatctatatctatatctatatctatatctatatctatatctatatctatatctatctatattattataaaagcatgaatacaatgttgaaagaccaaaatagccctaaaataattttcactaaaagttataagaaaaggatacaactggaattgtacatgttaaataaagagttataattgttatagaaattgtacttggtatttgagatttaaactgatatgtaaaagatatgcctatctctctcaaaacatcttatgaacatatgtgtgtaagtgtgttcgtattataattgtataggtcgtcgaagcacaatcaaagaactcataaagaaaagtattattaaaaagatactacttaaaagagttttagtttgaataggattaaaaggagtcttcgttagtttttcttattctcttactttaattgaaacaagactcattgcctcaataatggataaaaatatcatttgttacagaacccttcacataactttgtaggctattttgatcaaagaatataaataaaattctaacaaaatactacctccggatgaaataggctttttattggaaatttatgttggccgtgttgggtttttttggaaggatttttctttagtttattttaaattttctcttacttttactttactttttgacaaagtaaagaataatctgctaattaagataaaatataatcaaagaaaatataaagaaataaaataagttatttttcctattataccaaaattgtaatgaattaattatatattcttcaaaagctaaatatttttttataaatagttttgtgttggataaaactgtaacatttaaagtttaaagttaactaataatagagttcttaaagatttataatgaaatttataatagatatttgatttcataaatatgttattccatgttgaataatatttcagatgttattcaataatgaactttaattcaactaataatcaacgaaattttttgaaaaaatatcactagaaattatcattttcgtacaattgtgatattcagaataaaaacactcaacttttcctagattaacacgactacgaaaacaacaacatggcaactctcagacgttttgtgttatatttaaaaggctaatattttttatactttttatcttttaataaatggagggaaaattagagataaactctcttctagatgtatcttgctttttcgggtgttgtagtatcggagatatttagataataattaatgaatttatcaagagaatatgagatttttagtaagtacatcacaaagaaaaaaagaaaaaaaaatgaatgaacataaaactacacaaaactttttttagttatttaaaaccaccaaaaattaattaattttaaggaaagaaaaggaaaagattgaaattacaaaatgataaatccttttcttagattaattaagaccgttcagaaagattgaaatatccaatattaattttttgttataaaatattggatgattattttaatatagtcataaaactttaaaaacttgaattgaatcaacaatcaggtaaagtatttaaattttaaatttattatattttttattattaaaaaatatataattctggcataatatgtttacttactgtactattgataaaggaaaaattgatacattgttgacatgagacaatataaaccaaatcatgttcaaagagtttatcaatgtactctgagcctaagacaagaacaaaaaataaaaagtatctcgattttattgaactatccgcaataaggcacattaaataattatgctccaattttttttaatgtaacatattaaagatgaaccataaggtccctcttcatttaaagacttacttactattaatagaagaacgttgatattcaaataaattataaaagaaatgttactaaacttagacaacaacattttagaatgcttcggtgaggcagtcctcaatcttcgaaatactataagctttccgaaatttattaataactatataagtgtaacacaattcagtcggtgctagaaagttgtaggaacatattatgaagatacggtagacgactttagaaggatacaagatagttcatttaataattaactttttttttgtgcgttgaaaatcattaattattaattagagagtacgtgcaacaatgtatgatatacctaaacttgataagcgactagatgattaagtttcattggggcagagaaataatggaggaaaattcataaaagcacatacaaaaaagttttcaagactatattgcaaaaagatgattccaacaaagtagaattactctttgcagatgaacttaaagaaactgaaaaatattcctatatcgtcctttacttgcaaaatcataaggtatagttgccctagcaataatagtaagtggtgaaggcgtgaagcaatacgatttaacctagggtcgtatgacttgactcactaataataaataagacaaccattataaaaatgtgaaagtaaaataatgatactgaatcaacaagaaaagcacaattgattgtctgggatgaagcgtcaaacaatcaaaatagctgtaatagtagtgctgaacattgcttaataagagatatatttctcattatttaaaaaatacaagttgtgcaaaatatacgaatgaaaaagttatcttaactataaatgaatattcgaccaactaaataaaatgttgattatttttttttcttgtatataatttcttaaaatatttaaattattcaacttttatataaacaattgattaaatatatacgtgcgttgcgtagaaactagtaaatataaaaatatgtatttatagggggatgggatgctcattataaaagaacaatactttcacattctccgaatattctttctttatatgcatacaaaatatatctttccctcgtacctcacttttaacctttctctcacgatccaagaggaatactaatattcaaaggttcttcaatcacctatcattgtcgggaggaatttcgccggaattctttttcgtttataccacttgcatttatctacttaaatgccattatatttatttattactccttccggtccacaataaatatccaatttactttttaattttggtccaaaataaatgtctagttagataattaagaaaaaattcaatttgtttttactcttttacccttatgtgcatatccctaaaaaaaattccctctcatcatattaacttactaaataagggtaatttagtcatacaaggtaattttatatatgatttagtattattttaacgggcgtgctaaaagtaaattggacacttattgtggaccggagggagtattatttaatgttaatccaaatcctaaactgctacagtctcacccttccccctacggatactttatcacagaaaaaaagggaaaagaaaatcatctcttccttttgttcttattttaaccctagaaagaaacccatttgtgttcaactgttgctgggtttggatcgtttcctccaggacaggggtaaactaattcaatatagtatttattttttgcaatttctattatttttgtgttttgtctaagcaaaaatttcagtctttgaaccctaaaacgaacataaaattggggcctgcaatttctatttgttcctcctcctttgtgtttgtcgaagcaaattttcagcctttaaactcttaacaaacataaattctgtaaaaataattataaaaatccaatctttggaactcttttctattttggtaaatattttgaacttgggatgatactgctctgctctaatatatttttggattcctactttttttaaaactattatttcattccttatgacattgaaggtgagccttggagcaacgtcatagtttgtctccgtgtgacctattggttacgggttcgagccgtggaatcgacccctcgtgcataaacacgggatgcttcatgcaccgggctgcattgcctggccgttatgacatagacttacaatttttgactaatctgtaatgtttctgcaaaatttagttactagtgtttaattaaggtagtggcatgtagttgtttggtgccgtttcccccttaatttgctcatatgattgattgattgcttctgaagttaattttggatcataaatctctaactaaattgtgaatatcttatctgctaatgttatcatcattcgagtttgataattgtcttcagctaatatcatcacgaggacaagtaatttgggttcttggaattaggtgggaagatttccaagaaatcgatgaagttttgattttgacgggtgaatttgattgattcttatatcttgatgctgccatgagtgttttatttattctttgattagttgctttgtttggtgggatttgtttgttgaagcacaaaatgtagctatacacttttgtttccaattgttgctctgcatttattcttctctatatttttgtttgtttttgttttgttgcagctgtgaactttatgagaagaagtgaaatcctgtttacaggttctccagcgtatccttctccttaatcttatatatctctttaatgtaagactggcaaaacttgtatcaatataaataaaaaatttatgattaaatgtatgtgtctatctatctgcagctagatgggtgaagttcttcctctgtgtgcctctcctcgtggcttattcctctgcacttggacggttccctatcagaagtgctggcagaccttgaagactgtgattttatttgttaagaagtttaggtgggcatggccatcttcattgggtggtccaccggatggtgatagtaagtctctttacctaaagattgatattataaggttcaacttagcagtttatcacatacgaatagatagatacaagtcttatagatctgtataagacttgaggtgagagaccatatagggatgtagtcacaacatgatttgcaggaattatgtgaatgctgattatatgttggtaaaagaacttgggaatgcaaaggatatgtcattgaggttccaaattccagtttgcacgacatcgttgacttttgcgaaattcccaaccatgtaggatgtttttccaggtccccaaaattaatggttgaagcaacacttgtggacatggtgtttggcctgcaataattttttgataaaaatattagcccgaaaaagcagtaggttatttaaatattatccaactaggctgacatgtaaagcttgttttttttttccgttttaccataagcttcttggaggccaaagccaccaacattcttatacttcatgataatgtcggtatttaagaggtggatctttttcctctttgtatcagtagaaccccagaggaagttactttgggttctattaataatcttggttatgctctttcagagatgtaatgcataacgtgactgggaatactgctaagtgaagatctggcaattgaggaatgcataagtttgataatgtagactacattatgtagtcagtctgttatagtagtgcatcaagtttgtgtgtggtgctgttcactcccatttggtcataggatttcctttaaagttcttttatgaaaaagtttctgcaagtatagcttttctggtcgaacccgcccaaaccaactaagaagaaccgaacccgacagacacatcttttttgttatgaatcagccccagcccaatgtctcacaagtagctattaggctgactgctgagaagaggttttggaccaagaacaagtaataggggcaggtttatttggaatccacgttgagtatatgatgcaaggatggttctgttaaaaagggactggtcggttattttgggatgaggcatattgttgagaaaggtgtccgcttctcctagtctcccattcttcgagtctaatcttcttatccacttcttctatctatccctagttactttacttcatacaatttctattgtaattctgctactaagttgttgcattttgatatttgagttgtaatcacatttcagtcttactctcgatttgagttcattacatttttccttttgggagtactgtgacacagttgttacagatctattcctgtctcacttatgaagagttacttcaacgtttccttggtcatttctagccattacctttctgcagatttgacattttacagttgtgaagatatttactaaccttcttggttaaaatttccgattgtgcttgttcacagcctcttgtgctcgattttgtgtttttgtaactttctttatgacgtaaatagatttttctagtgtttttcagggcctctcgtaatgggcattgagagattgtggtggtgtttgggcttccttccctacggttgcatggtcactgccgttctggattttgttcattattcgatatctttcatcgtaatatttatgggctatttttttcatttggctgtgctatactctattgtttattggcatcagtacatgcctttccggttaattggtgccaaggcgaaattcatgattgaggtcattcccatgataactgcagcagccttgcatcaccttttggagttcaattatgggtatctcgctctactgctatgctgcaccacatatttttacaccgttgcccacttcttgcacttagcatatgatatcggggaaatagacgtattgctgggaatagtcatgcaggttcttgcttacatgctgaacgtaggattgttagctagagctttggctttgagcttctgctttgttttatgtttctatagatacatgacgtattgtgctcctgaactacctgttcatcataaaaaggagttggagcagctaccttgttgatctgtatgtactttttgaaagtaagagaaacttgcaattaattttttgtcatgtaatctttttttgtctgtttaatctatcaggtttctttcaccttctttagccgagggtatatcggaaacagactgtgtacattctgccctccacagattccacttgtgggattatattggatggtggttgttgttgttgtcatgtaatgagcccttggttcacacctctgctcttcttgcttacatgcaggttctttaatttttttatccccatgaaaaagtgaaataactaatcccggaataattaatcttgatataactctttccaaccaaacgacccctaagggttttaagtcattggatactgtataatacaaccattggaaaacagacatcatcaaagaaaaaaggtcaaaacttgaaactacaaaaggaaaaagagaatttcaatttgtcaggtatatttaaatttcgaatcacttttatatatatcaactagtgaagaattgcccgtgctaagcacgggcccaacaccacatttttttttgtgggcatgtcaaattctaaactgaacatagtagctatttggacgacgcctgctatatgcaagtgtaaaaacttcaccatccttgaggataataataaaccaagcagatagctatctagcttagtaatcagagtcgtcgttgatattgaacaaaaactgaggccatgacgcaattcttgaaagatttagcaataaatagcctaccgattcttttcttgacatttaccgagttggatcatttgattcatactgtactgcagcagaatcttcagaatcttcaaccttccttccactaatagctgcgggaaaaaaactgatcaatataattcatcagttctttcctccaactgcaacatcaacacaattctcattcttattaattgtaataggatccttctgaagaagacaacacagagaattgacccttgtcacgggggatttctcatatgctgacatattttgagtggtactaaacaagcaattcgaaatcctcttcagctgacagccttttggtatttcagttttttgataagagtcaaatgtaaaacgcatggaaacaatgacagattttctcatactctttgttttttgaagatgaaaatataacggcaaaatagaaatctcaaaagctaaattacaataagatgctatattcattcgtttcctgctatctactttcccagcaagacaaatatgttgattaagcaaaacagcggccacttgttaatagatgggtagtctcatgaaatgtacacttttcacacacagcttggccctaatatatagagcttagacatgccgagcaagctgcatcaaagatttataatgacaaaagacaataatagctcttaatagagcgtcgatgtgccaaattagacaagatgaatatttgagggacggcaatgcaaagatgtttttcaccttagtcatattgagaaaacatcttgcattgcagtaatggttgctgttatttgtccaaatagaagtgttgccgcaaaagcgttgaaatgtgtgaatttgattgaatgataagaggagtaaaatatctacagcgaagatactgcatatcccaatatgagaatgaaagctgaaaagaaaaaatgaggaagtgtatccatgaattatttacgattatagcatatatgtaccaacataattaaggaagacatattttactcattcaactatttaatttacattcttttgtcttaagatataatataaacatagtactactctatacattctagttttagggaagacaaattatgtgaacagaacattgagaggaaactaaaagagagagaaacaaaaagagttcttcaatgtccatttcaattttttctttatgtaaaatatttatggcctttcatgttttccctacaagaggactaaactgttgcatgaatgttattatttcctctggtaaaattccatataaaggaaagaaatctgaactaatacaaatgaacttggaaggggaaaaagtaacaatactgaaaactaacttcaagcgtcggtaattccatattagaaaattatttcaatctgtaatatgcctaatacacacaaagaacctagtatagcaaatgattcaaaaatgtaagaagtggtacctatttgactaaggtaaaatgacagtcaatacaaaaattgcgtaggctaccaactttgagaagaaaaggcacaaataaatattcaaaaatatgctagtagcaagacaaagcagattcaaatataaccaaagtccaacagaactaccacagcatatcaatatagaagaaggtgaaagttacctttcattggcacaagaaaatctgaatcaagaacaagcgactcgtcttcttctggagacgaaaagggaaaatacaaagcaattaaagcaagacattcggtctaaaaataccttgcagttctgattaacctaatccctaaaatatcatcattgcccgtttaaatttcgacgtttgcataaaacttcagtctggcattagttataaatgaaaattcagcagttatccaattcaataaatatcagaaatctatgaaactacaagaagctccctttcaaagttaaaaaaataaaacactccatgagaaagtgaatcaccctttggccagagtaggtaactgacgacatgtgcagatttttcctattttggtaaacaacaatatcttttatcgcacagtttttgtggaacgtcaacatactcgacaagagttatgcctctttttaaaattctatgttttgatgtctaatttctacagtttgatattttaattctactttagaacttttgcaccttgtcattaacttgaaacttgactcacagatgcgtgagtcaacttgtaacaattgacaacataggataaattgtaagtgcaggccgcataaaaatatactcatgttggttttgcagtgaaagtacctaaaagaaagttaatgctgacctgcctagcacctatgagcagaacaaaatcctacagaagtaaaaaaagtataagtatcagtacctatccttatgttgattaaagaattttcataatgacctgacaaaatagaaacagaaaccaaaaatcacactttactaacatagcagcagcaacaaaaagctcactcaaaaacttctatagtctaacttgatattgagcatctttaatcattgttttaatttagttacaatcttaagctttttgtcactgctgcttctagttcatagacatatttggtggaattacacattaaactatctggccgtatgctatattgttgtttgtgccaaccaagaaaaggtcaataatatacttgtagtccatgttattttagagcaaaaatttaagtacagcccgtaagggctaaatactcctttcacctctcaaggaaagtttatttggaggactatctaagttcgcggtttttattttttacatatcataggcaccttactgaaagcttggcatatattttgacagcatggataataaaatgctagtagcagcaatgacaaattaaatatgaacatgtttggaatagtaaaagtttgtggcgcttaagaacaacacgaaactcacccgagaaaattgaaatacctgaaagcatgtagttcagagaaaatcgaagaaagaataagctgaaagtaaatcatgcttaaacgcatatgaatgaagtgataacaatgatgattcgcaatgaccatcccagaaaaaacaatcgactaaaaaataatcaagtggagagaacaagtagagtgaacagaggaaacgtacctgagagaagagaatttttgagatggcgaactttcgaatgtggtagattggtaggagaagatttatcaaagcagatactcccgaggtgtaaaattacgtgataagcctccaatataagcagccgattgtcgaaacattgaactactctgaaattagctgatatagactgctgaaacgttaaaaaataatttagccctatagctatttagactttcttctccctaaattgttaagcatcaatacggtcgaaagttttgaagtactatcctttgctgtcaatattcgaaacacaaatcaaagtgaaaacgaactgcagaagcttgcgaaatattagaagtataaaggacagtaagagaatccaaatcaaagtgaaaaaggaccaaataattgggcataaaatagtgatgacagattacttacctcaattaaagaagaaactcataaatcgaacaaggaaaccaaggtaaagggtgacgaaaaagtaaaacagaaagccaaataaaatgaagcacacaattagatacaatctcaagcagccacttcggtgttgtaaaggcagtaggacaaaatttaagtgtaggtgaaagagtaattttataaaaacacctaccggacatagagaataaagataagagtacagagggaaaacctagagaagaagaagaacgaagcgcttggtaccaaacagaagcagagcaaagaaatgaatttagaagcgcttggagatatagaattgagaagcggtgctttctacagcagcacctgaaatggcaaaaatgcccctgaagcagacatgttgaccatcacatgcctgcttatcctcacctatagtataggaatagataatactcgacataattcaagaatttaataaatagtaaaacatttttatacaatattttaaaaagggcggatacgaggcgaggtattttactgtatataacaaggtgcaagcctcgaggcattgggcttgagcccacgtgtttttacatttttaatatttttaaattaatataataaaataaatactaaaataagacaaaattacaaagagattttagaaattataaaataaatgatacaactactttatcttaaaaagctaatttgctcagcaattgactaaaaaattaatccaaaattccttcatacaaaaattatctgactgaaaaaattgagtagaaatttataactaacttaaaagagcaaaataacttaaaaataaagaacaaaagaaggaacataaatcagaagctttgaaccagagcgaatcgtgaagatatgtttttattttgtagtttgcaaattggtaattttttctttacgatgtaggacgtgaagagaaagagtaaaatttaaggggtaagaataaagtatttttttttctaatttttttattttttttaaacttttaaggatgtaataacaagttgaattttgtgttttttagtattgaattaatgacctttttagtagttttaatcttaatttggaaggttttctggcttatgccccaaaagaaaaacttgtccaacgcctaagggtacgcccataacaatggagcttacacctcgtgatactttttccccatcgaatcgcaccagtatatttttactacgcctcagcccagggctcgccttaaaaaccttttttaccacactgtatttacaatcagatagcatgtactttaattttagaatattgtggtatgtctaatttgtattccaaattagaacattataatgtgtttagtttgagtattatattgtgaatgtttgatttgaattcttattccaaattagaataccatagtatgtttggtttgaataatgtattttaaattagaatatttttgtatattttcagaataaatggaaatatttggaggtatatcatgtactaatacttttgggattaatgtaattttaaaattgaggtatatcatgaaagtacatctctcgaattggtgtacagacaggcctctctataacaacgtccctatacaatagtcattcattataaatgtgacgacccaaagggtcatcaccgtaattctcccttgctccgtgcttctgaggcctcaaaaacctcttgaggggttgcctcgatttgcgtgcgcagtccgggcgcgaagccggaaaagtttatattatgaaggttgatatatgtgttgaaaatgtgaaattttaagtataatattgatagggttgacttcggtcaatatttctagcaaacgggcccggacccgtggtacgtcaatttttaaaaatccgtagtaaaatatgggacttgggcgtatgcccggaatcgaattccgaggtcccaggcccaagatatggaattttctgtgaaaattatttatgaaattaactaagaaaaatgaaaatgaaaatttgattaaaagttatcgtatcgggctcgtattttggttccgacgcccggtacaggtcttatatggtgtttaagcactatctgtaaagtttggtcgaaatcggacgtcgtttggcgtgtttcggaccctaaaagctaattttgaagtttgaagtttaaagttggaaaatatggattttatgatttaattcgttgtatttgatgttatttaggcgatttgatcgctcgagtaagtccgtaggatgttaatgaactagtttgagtgtttggttgggaggcccgagggctcgggagtattttcgggggtggttcggggtgattttgctttgaaaacacatcagattttccctcagatgttgcagactctattgctcttcgcgatcgcgtgtgagtctcgcgttcgtagctttggtgcctgctctccttcgcgttcgcaaccttccctcgcgatcgcgtagttggacctgctctctctctgcgttcgcatcagcctagtcgcgaacgcataggccaaaatctgggccaggcctttttcctcttacgcgttcgcatagagctgtcaatatgggctgggccgggctagcccaacccagcccatgtgggcttgagtaattgacgggctgggctgggctagcccactattttggtgggctttataatggttagcccaccccagccctatgtgggccacgggcccccacgggccggcccattattttttaaaatataattttatatttttctttaacttctaacgtaaaaaagataaatatttaaaagttaaaaaatatcttattggaaaaatttcgcaaaacttaataactttttaaactgtaccaatatatcacaataaatactaaaatgtaaaagacaagactatatttcaatcactaaaagccaaaactcaaaacaaactattcaagagaacgtccatgatgcttatgtgatatccaacataagattttctttgaagtttagccgtttagggtttagtttagacaatttaagattttattagttatttatttaataatatattttacttaactaattaacgttttaagactttgaattttgatattttaatataatgagcttaataaactttggacaagaggggttgctctgatggtaagcaacccccacttccaaccgagaggttgtgagttcgagtctccccaagagcaaggtgggaagttattggagggaaggatgccgggggtctatttggaaacagcctctctaccccagggtaggggtaaggtctgcgtacacactaccctccccagaccccactaagtgggattattctgggttgttgttgttgttgttgagcttaataaactttaagcttgtgatactcttcttgttatttttagtatcatatactttttatatgttatatattttatataaatatttttactaggcccccgggcccccacgggccggcctcagtcaagcctcacgggccacgggcttactcgggccgggcttaaaagcctcgttttaaaatgggcttcaaaaattatagcccaaccctgctaaaatacgagttgggttgggctggcccaacgggccaagcccatattgacggctctacgttcgcattgctctatcgcgaacgcgatgacccccaaaacctgcctgcttcgcgaacacgacctggtcccgcgatcgcgtaggcttaattccgtcagtgattttattatttcagagcactgttcatccgcgaccctcacttcattttcactcgaacttctcttctaaaaacctccattgacggaaaaccaagctcctaatcttcctaattctttgggtaagtcaatcctaacttgattccttcattatttcttcatcaatcattgaatttcctatctctaaaacatgaatttaagctagaaattaagggttttggggttagctagggtttatgggattttaggcatttcaacctcaatttggggtcgaatttaaaaactaattatatatttaaactcgtggggatgtgggggattaggttttggtccgaacctcgagtttggaccacgtgggcccggtgtcggattttggaatttttggaggaaagttaggaatttcatttctaagctatgggttgctgttattgagttgttattgataagattgaatctaattatgcttagatatcgttgtttgggagttggattctaaaggaaaggcggttgtagagctttgaattgctagtttcggcatcgaggtaagtgtttgttctaactttggttcgagggattaggattaggatattatttgctatgtgttgtgtggtgtcggagtataggtttggtgacggttacctatgcacccgagtcaagcatgaccgtgagtcttttaatcgttattgttcgatgctataacatggattcttgttgttgaactgactcatatgatataactttttggagttaaatgaataagatggcttaaacgaggatttcaagtgtaataccttgccgaaatatattgactctgttgtagactctcccttgtcgggatattttggttgttagctgtacccttgccgggtttatacatactgagttgttgattttccccaaacggggcatgtcttaaagaaaactaaatatgttatctattatttctcgggttcatgtggcgcgccatccacttatttattacttcattgggttcgtgtggcgcgccgtccacttatttattacttcattgggttcgtgtggcgcgccgtccacttatttattacttcattgggttcgtgtggcgcgccgtccacttatttattacttcattgggttcgtgtggcgcgccttccacttatttatttcttcattgggttcgtgtgacactccgtccacttatttactagttcattgggctttatttattatttagtatgtgcatttggatgcttttgacttatttgaaaattcgtaattctactatcattttagacttgtttctttctgtatttactgtttccccgatagcatgtcccctccccgttgcttatttaagttgtattattgtttcctgtttttgtgtatatatatatcttgcacaggttaacgctgtaggtcctgtctagcctcgtcactacctcgtgaggcggggttaggccaggcacttatcagcacatggggtcggttgtgctgattctacacttctgtgtctttttgtgcacagatccgggagcagccttcggagcgcagcatcagtagtagatagggagcacgcttctagttccgagactacaaggtagcttgctgacgtccgcgagcccttagtctcctcctattatgtagtttgtttcttatttcagacaaacaactattgtatctctttcttcaaactcttgtatgtagtaaatcttagaagtccgttgcgctgtgacactagtttctgggtagaggatctcagtttatgttatttccgcacttcttttctatctttaattattggagatttctttattattaaatgatgtttctatttgatattttatcgaggtttatgaatgtttaatctttgctgagtggcttgcctagctccttcagtaggcgccatcgcgaccccgatggtgggaaattcgggtcgtgacaataaaagcctagtttttctcagaattgatcttttatattatactttatctctatataatagctttctatctataaagcaacaaccatctttatgagagtacgctcttgtcacgtcccaaaatccgagggcgcgaccggcactcaatcgggtatccccagtcgagcggacctgggtgcctttcctattcccacgcgttaccccacattattccttattgattaactaaacaacacttgatgcaactgaaaataactggtaatcctcttttacaacacatacatactatcactaacagctagcgtggtttacatattacaacgccaaaacatatacattacatgcatacataagttctaacccgcatcgtactgtctacggagcctctaagaagttgaagatgatacaacacttgccggcgacaaggtccaggctatacctttaccaaaataacacaaaacgataattactacaacaacagaggtggcctgaaccacgcggggcccagaaggaaagaggctcaccaaattgaacacagctgataagtagaagaggaggagctacaggcggtggactggagtgccagctacggatccacctacaatcataacacgaatgtagcccccggcaaaagggacgtcagcacattggaattgtactggtatgtttgaacaaaccctgtcccaagtaatctcaagcgaccccgcctgacagtttttgttcacaaatagcaaacagcacaacaacaacaatagttttcaaagaattaatgatgccactttactacaagcaatcacaacaaatatgataagtattccaaaaccaatagcagccatatttctcatatttctcaatttattcacaataagggctacaaccacaattattcactttcgttcacatattccgttcttcactttctttccgtttttcatcattcaagaactctttaaatcacaaccaaacagcaaatcacaaagataaacaacaatcaattcacaaacaagaagagcaacaacaatacttctcaagacacaaccacaacaatattacgagtatttccatagccaatagttcgaattccattatattcaatagttcataggcaattcaagccattacaataattacccacaagaagccaaatatgttattaccacagttgttccaattgcgtcatttacgatttccttctaccatttgtttctcaactcttaccacataacacttgaccaaaccaatcaaacacccaacaaaccaagcacaagaatttcacaaacaatccatgtagctatcacataccaaatattcatacaccaaacaaggcgatttcacaaggatcaaagttagccatacatacctcgattgagctttccttaagttactacaaaactccaaaaaatctagcaattccaatctactatgagacataacaaaattaaacacatattagaaagatattcatgaaactagctcatttgagcattttatcaaacactagttgagcatcttgatttcgaatcccctttttaagatttccttcattccctaacccaatctttactaatctatgttaaacaatcttcccataagcctaagttgtacatgcatgcatacataatactaaaatacccaagaatcatacctcaataacccatcttatactctaaactcgaaattaaaacctagggcataaaatcttacctcttagatgaagaactagggccttcacttgattatcttcaaggaattaacaagattttgtggagaaatttgatgggagaaactttccttctctaaaacccctctctctcactctaaaaatactcagaagaatgctcaaaatgagctatggggtcaaatataacgatagggggtcgggtttagaaattaaaaaaaataaccccaagatgtcggttctgctatagcagattggaccgcaaaatagacatgcggtccgcagaatgcaccgcaaaatcgacacccaaaactgggctacactggcccattctgcggccaaaatgcgaccgcagagtgagaaatgcgacctgatttgcggtcgcagaattgacacaggatatcattttccagcctttggtaatttgaccataactttgcgtaggaatgtccaaatgacgaacggtttgaagcgttggaaactagactcaaagggatttcatttgatatgctattcaccacataaaaccttataaataattatatatgctcttttgaagtggagccttatgcgaatccatttggaattttggcctatttcgaagattttcccatttagcatacacttaggcttccctttggacctcacatcacttaccataagacttatgctcatatttaccttgtataattgatgtccaccatgttaatagtatataaatatattataataagcctgtgtgacactatgaaatcctaaattacttagcgaaattttccggggccttacattctccccccttaggatcattcgtcctcgaatgaggagtagagtcttccccaaacaccttaacatcacacatctcttttctaacctacctcaagtctctaaattttcattaactcccaattgtttcagaaattttggcagagtttcctttgtaactaggcctatccaccagctagagcatcaccaaattcgtctcaacaacacacccacaactatacatagcacaacaatgtatgtatccacaatcctaatcccggtgttgcaagcactacattatcataaggataccagaacatggactgcacagttttagatcaatacacctatatggtacattccaagtcaaagctaactggtattcaatcaagcaaaaatattttccttccacgacacattcagctttccaaatgacattatcgacttacacgcattgtcatgacaccttctcaaataatatcaattcctaaacatacataacaagggtgacaaataacatcttgcatgagataactatccattgactttacctttcgataacttccactatacaatttacactccactggatattgcaattcatgataacaacaataacccacaattccataacatggcattataccctcaaggatgtcatttcatagcaaactaacaatcatgtgcttataatagtccttaccagctattaatgtaatcacaaaggtgttcatcaacaagaatataatttcatttcaatctaccatccatatgaagttaagccacgataattctttctagtagtgaatcatatagtatattaccatgatcatatagttcaattaaattcactcacacccctcttttaccactaccttcttagacataggcatattaaaacacataatacatgtaaaacaacgatggtaaatatcatactcattgcatggcttacagtgaacaacacttatgcaaccttcattatcaactcacctaacatctttagtggaaagtattaagaataacccattcacccttctaaacacaaaatctccacactcacactcacccaaagcattgattaccttcaacaataactctaggatgtgctattataaactgatgataatattacatgtcgaatatatgggatcatacggggatacttcctctttgacatgtttgaaccttcaatacccaatgggtctaatacagtaaggagcaacgaagtccaagattgggctggaattatttaggaatctatttagacgctgagcagagtatttcatgaggttacatgctaagagacatgaaatttctatcaatgatgctgatatggttaatcattgtgacgacatcaactattaggcaattaaggcatcggggtaattcatacattggcaataggaaccactaaggaggaatattcaattcgggacccagtcatctcctagagtgttggaaaagtcagtttatcaagaataagattgttctggtacctataatgcgatatggtttaaaacacacgaagttgaattacactcttaacgctgactgacacaaggaatatatgccgcaatcccaggaggataaaaaaaagttgagtacctatggacttatcatactttgaatagcttaacccctctcgataactgatcttatatgagagaagtaaagatacaataacttgtcttccaaatcaatatgctcacgatatgcacaaaaatctgaagacatctaatctcaacttttcaaaggttaaaccatagagctaggacaccttgatattggaacgaaatcatgtatcagttagatgggttcaaatgattaatatgatactccgaggagaaagacaaataacactcctatccagtccaagaaggtgaaatgccaagggtagcaaaaactccccgtatataacaacgatatagccaatggttctagaagtcgagggtgtatagacaaccaacatcaatgatacagtgcaaaataatcataggagatgcgaagatgttcatgatgagttctccatgagttcttggcttgaagaaggaggtgtcatagtgacacatagaagggcacattctctcatggttatcggatagtgttgggaactagcaccgtcaatttcatcaaccaaagatcacaattaacccatgttacagaggtggaaagagaaacaaacatttgttacaagatggacatgcttctactaggttaactcccagactacgataccagaccatatcctgggcaaccacaatactagaaaccaagtgagatacttgctacgggataacctaagtggacacgaaatttatggtgacataagaccttcttgtgatagggatgtgaggatctcaactttccagaaaacctttatgcacacggtgaccattttgattgatatgcactcatgggataggtgttaaggtatgctcttatgttactagacactgagaagctttcatgatgatactcacaagagattagattgggtgttcaaaccatatacgccatatgcacaactgagtaaaagggtgactcgagaaggatcgcaacacagggatgcttcacatgaaacttgactccacataggtgaactttacgacggtgcatgcatagttacgagtgagtaaattttgtccatttaaataaaacgcctctataagaaattcatcgggaatgataccttgctgaggatttaggaaaatcaggtgagaaatatcaatagtgttataactcaattcaggaacacaattatggagctcaattccacagaaggctataaatgagaggatcatgaccgggagactttgtgaataatacgtctcattcagagagcagatgtatgcaatgttttgtgatttagattctttttaataatatatatatgcaaagacaaggaaatcataaggtttaacaaaagctttaaacaatgaccacattaccaaataaaagggatcacatagctttcacaaaatttccatatctctaggccgcatttcatagcccccctcatagggttcacatatcaaattatacacctatgcgtttcatagaccgtccataggttccacacatcaattcataggcacttagggccacaattatcacatcatacttggcactaggccacattttataactcaagcacttgtttcccacatttcacattatttccacatattccacagttcaatcacacggcttctggccatccagaatattatttcgcaacaacaataacaattcacgaagagttttcattaacaatggaacttgactcacaatgaattcttgtacaatcatgacaatatgcaatttcaacgtctctatacacagaggatttcacatacattggacataatatatgcagacccgatttcaatttaagggccttaacatttcaatacataattcatattccttgtaccctttttaagttagcaacaaacgaaccttagtcatattggaatgcatcctctacaattacagggtcacaacatcaattcatgtgaactagaaatcacagcaagaatctgacatttagtctacagtcactcacttcacctcaagacatctttatacattaccaacaactagacacaagcaatccaatacatttggtacacataggaacaattttggaggatcaaccataacgatttttctcacacaattcggtatcaaaacctcaatttaaacttgatttgaagtctaggcattttagcatatagttcacattcttcacatatcctcatttgccgagaataacatattagcacatgaagaagtacctcccatatatattttcacaacaataattcgctaaacgaaacaaaacgagtattacatcaattatattttgaacttacaacatttacgcgagcacccttgaagctcgacttctaaaaggtggggttctagccgtacatactgatgatatactacatgacctggtggtgtagtgacattagttggaacaaaggtattctccttaacaacaagttctaccaatcacttcattgctcaacacattcttctaacaagtccttgggtaatccactcgaactcaatggtgggttaaatccctccttacatgcttccaattcgcggatgatggtatcaaaattaccaatcttgagaatgacacttagagaggaaattagctccctatcttgagctatatcgcacgatccggaatatcaaggaagagaatagttttcctaaatgcccgtgcagccccctcccattcgatgtggtcgacaacacaccgaagagaagggctctactagacacagtttcgagacatcctaggactcctttaaaaccttaggctctgataccaagtttgtcacgccccaaaatccgagggagcgaccggcactcaaccgggtatccccagtcgagcggacctgggtgccttttctattcccacgcgttaccccacattattccttattgattaaccaaacaacacttgatgcaactgaaaataactggtaatcctcttttacaacacatacatactatcactaatagctagcgtgatttacatattacaacgccaaaacatatacattacatgcatacataagttctaacccgcatcgtactgtctacggagcctctaagaagttgaagataatacaacacttgccggcgacaaggccccggctatacctttaccaaaacaacacaaaacgataattattacaacaacataggtggcctgaaccatgcggggccccagaaggaaagaggctcaccaatttgaacacacctgataagtagaagaggaggagctacgggcggtggactggagtgctagctacggatccacctacaatcataacacgaatgtagtgcccccagcaaaagggacgtcagcacattggaattgtactggtatgtttgaacaaaccctgtcccaagtaaactcaagccaagatacaaatacaatagaaagccgatgatacatgaacaaataagcagctgaacaacaatggaaacatcaaccaaacacttcacaacagatagttcaattagccaaacaaaggggaaatcagtgccccacaggttgcaaactctcctactgtctcctttcacaattccacatttatcatttcatgattttaaatcatttcaatagtgatattggatcacttttccacccttattacctcggccacccttattacctcggccacccttatcgcaccaacccacaccttatttcaccgtgttgcggcgtgcaacccgaccccgcctgacagcttttgttcacaaacagcaaacaacacaacaacaacaatagttttcaaagaattaatgatgccacttcactacaagcaatcacaacaaatatgacaagtattccaaaaccaataacagccatatttctcatatttctcaatttattcacaataggggctacaaccacaattattcactttcattcacatattccgttcttcactttctttccatttttcatcattcaagaactctttcaatcacaaccaaacaacaaatcacaaagataaacaacaatcaattcacaaacaagaagagcaacaacaatacttctcaagacacagccacaacaatattacgagtgtttccatagccaacagttccaattccattatattcaatagttcataggcaattcaagccattgcaataattacccacaagaagccaaatatgttattaccacagttgttccaattgcgtcatttacgattttcttctaccatttatttctcaactcttaccacataacacttgaccaaaccaatcaaacacccaacaaaccaagcacaagaatttcataaacaatccacgtagctatcacataccaaatattcatacaccaaacaaggcgatttcacaaggatcaaagttagccatacatacctcgattgagctttccttaagttactacaaaactccaaaaaatctagcaattccaatctactatgagccataacaaaattaaacacatattagaaagatattcatgaaacgagctcatttgagcattttatcaaacactagttgagcatcttgatttcgaatcccctttttaagatttccttcattccctaacccaatctttactaatctatgttaaacaatcttcccataaacctaagttgtacatgcatgcatacacaatactaaaatacccaagaatcatacctcaataacccatcttatactctaaactcgaaattaaaacctagggcatagaatcttacctcttagatgaagaactagggccttcacttgattatcttcaaggaattaacaagattttgtggagaaatttgatgggagaaactttccctctctaaaacccctctctctcactctaaaaatactcagaataatgctcaaaatgagctatggggtcaaatataacgatagggggtcgggtttagaaattaaaaaaaaataaccccaagatgtcggttctgctatagcagattggaccgcaaaatagacatgcggtccgcagaatgcaccgcaaaatcggcgcccaaaactgggctacactggcccattctgcggctaaaatgcgaccgcagagtgagaaatgcgacctgatttgcggtcgcagaattgacacaggatatcattttccagcctttggtaatttgaccataactttgcgtaggaatgtccaaatgacgaacggtttgaagcgttggaaactagactcaaagggctttcatttgatatgctattcaccatataaaaccttataaataattatatatgcttttttgaagtggagccttgtgcgaatccatttggaattttggcctatttcgaagattttcccattttggcatacacttaggcttccctttggacctcacatcacttaccataagacttatgctcatatttacctagtctaattgatgtccaccatgttaataatatataaatatattataataagcctgtgtgacactacgaaattctaaattacttagcgaaattttccgaagccttacagctctttttaaaataactcctttataacaaccatgtagattttctaagattattattaataattatctaagtattttaatgaaatattttataactttaatgtaaaacttataatcgaaatatatatcttaaagataatagtacgctccatgaaaatatgcacattattattatgtttttttttgaagttataaatgatatgtttttctttagaaaaataccaaaagatacttaaaagatttgtctatactttttgaagataagcatatcattctttttttttttgtgaagattcaattgttaagctcttagattgtcttcaaggaaaaacaattggatatccttctgctgaaagtttagatgcaaatcttcgccgattcaagcgttataccactagtacgagactgaaatctacgaaacaagctacaattatggagttcttccatcaatcttgaaagatttaattgtgcaccttagagtttaatgtttgtacgtttagttatgattttttaaaataatttattagatttatttagcatttaattcgtgaaatattcatatcttttgagattttgaatttaaatatctttttacctttatatgtaatattaaaaaaaaaatttagataatttttgtctataacatccaaaatatattcaaacgccaaatgttgttataggtgtataacaaccattcagtataaaagccaaaacttttcagaacaaacgatgttatagagaggtttgagtgtatatcattaaacctttgcctaacctcccattctttgtgggcccgttttcctttacgaagaattaacacaaatagccaccccttaatttcttaaactaaaagtagctggcagatgtataatggtaaagttcaagtacaatatgtgtataattgtatataaataataaataatctatatataaggttataaaaagtaaactgtgaatctggccggctatttgtgtaataatacctttctttattgtgtctttatgattaattttctttttcaaaattattgaatatcataaggtaaaaaggtataaaatagttatgtaatttgtattttcttttcttctcttactaatttattccttcaaaaacaaggcaaatgacataaattaattttacatttattgtcattatttctcatattttcagcgcgataacaagcaaaacgaattagaatagtgaaattcttctgctttggagtttttacttcataggtgtatatgaaaaaatgacgttgtatagccgctgtaaaaataatagccgaaaaaatatataatatttgtatatttttttgtatatatatgcattctgtttgttatatacaaaaattatataagttttatacactttttcggcttctaatataaataatttctagcgcgggcttaaagtgataatacctcggtgtatattgccttttccccttatatattagaattcaagtatgtcaatatgaataagattactcaaaacataaataagattattcttggattttatatacaactaaaagaagatttcactaaataatgacctcaagaagattaaatggattatttatattttatattttcaaatggaaaagaacaattagaacaaatcatatacaatatcattaatagatacaaatatatactaaattattttaaagtttaaggcttgttaataaagtctggcttaaggccacaatttttcttgagctaccggcccctaggcttctttcaagtcgatacaataactttcataaaaattaattacaataactatcctaaatcatataacatatgaaaagtgaatattggatgcctcttaatattaccatagtacgaattgaaatacgaaaaacccatggtggaaattcgtagcaataatcatttgttttgttttctctcaaagttgttgccaaaaatttaagacaacacaaaatgtagttgttgccataacaatattttatcctcaaaaggtcatgttattgtgacttatggaagcatttagcaacaaagatgattgttgccctgcatctttttttgggtttttttgtaccccattcggaattcgctatccgtattggagcccaattatattcgaatttgccccgcataggatcccatttagggagaagcgctccgtaccaagaattttttcatgcataaagcttgaacccgagacctctaccaacaacaaaaagagattaaaagaaaagaagaaacacaacaacacaaacacttaagtgtggggttccgggcaacgtcagccaccacaatctcaatcctgacgaagaagtagtcgagccagagttgttacccatcaccttagtttatgttgaataggcatacccgacttccagctaattgtcaaataaagctttccgtgctttaattccaccaaaaagatatttcgagaacctttccgaacgtctgtcttcgcggggcgctcaaggccgagtcggaaagctttaatttgtttgtagagtctctttcagttcaggtggaaaatttttggacggagaaagactatatagggcatttttactttggatacgattcttttttttagcatatctatagtcaattgattgagcttatttgaaatttatatttctggcctgtccaaccctaaaagccaccaataatttttatatgaataaaccaataaatatcatcacttttgcgatgttcttcgcatatgttgataataaaaaaaaatcacaatatagataatacaaaatttgtctcataattcacttaattttttttaagaacaattagtagccaaatataatcttatgttcaaggatttgcaacacattatacgtatagctcacagccattgcttgacatgatgacaatcgaggagtttccacctaacatgaggaattgattaactaaaaaaagaataaactgtaatatagctcatagaatggtattattgatgagtccgaaaccaaagtaatacatagttcttttttgctttcttgttttctcactggctgtccggtacctgtattcaggggcgtacccagaattttttataagcggtgtcgacatttaaagacgtgatgaacatcatattaaaaaattaaaacacaaactctaatatatgagtaaaacaattcaagtacattattaatgttttaaatgtattattagtctcgttagaattaatactaaatattttcttttgtataatacaccagacaagcactcaaaaatatgtcattcatttgacgagactaataaatttacaagtagcatgcccaattctaaaaaatcacaaattgcatgaaatggccaaaataattaccaatttattgtggttctgatattgtaagcacaccaggatctacaagttttgtttttagcgtattaaaaaaattctaaaaaaaagaaacagggaatcgaactccagatcttctccagcaaagatgtagcgctcgaccaagtgagctaagagctctttctgttacatgacgttgcttcatttaatttgtatagtatttagtttgcatatcaattcatattcatatatttagtaaggttttccggtcaagcggtgtcagatgacaccgcttgagtccaggtgtatccgcccccgtccatattggagcccgactatatccaaatttacgccggatagtaccccattcgaagggaagcgctccatactaaggattttatcataccatacaaaacaagcattaacattaagtttcttgaccaaaaacacatgaccacatttatccattgctacattatttaatataacaggcaatggatttacaaaaacacatttttttcttgcatgcttcaaaccatccttggccattttatgagccaccttgtttccttccctaaaattatggatgatcttcgggtgcttcaaccggtacattaaccacctgcaatgtgtaagagtagtggagtaagtttttgcattagaaaaatatgccgttgcatccgtttccacaattaagggagagaaaccgtaattgagtgctagtgtgaggcctaatttcaatgcctctaattccgactgcagtggggaggatgaaggttttgagtgttggaaacctaatagccaatccccattgtcacttctgaaggagggttccccccatacctcctaagtttgagctttttttgaaaacaccatctatgttgagtttaataacattctggggtggtttgtgccaagtcattttaataggaagagaggtgggaatggtgggttttctaattgtgtaatagaaatattcttgggctaaggaaataacattagagtttttgtagttgagggataggttgttatggttgttattatttctatttgaccaaatgcaccaaatgataaacaggaaaaggaaatcccaggacataggggtatttggttgatgaatactaatatttctgatcttaagaagccagttgctttgcccatttcccctagtgagctttagtcctaaggaagtccagaagatttttacggatttgcaaaataggaaaatgtgctcaatagtctcaattccgttttagcaaaccggacagattggatcaatattaataccgatatggtgaaggtaatgacgagtgggtaacctattgtaaagacatttccacaacaaaaatttattttattcgggcatttggatttccaaatccagtcaaaatcaaataaaatttgaggattgagagttataatatcgtaacaagtttttgtattaaagagaccatttggagttaaagctcaatggaaagtatctatagagtttttaataggctcaaaagagagaatgacatttttaatgtttgggggtaaattaaaggataattttgagaagtcccatatattattaagccttagatcccttatactgagatgttcgtcaattgtggagaggggacctactaaagtttttctaagggtattggaattttgaatccagtttgattctcatatgttcattgaagaatttaggtgagggatccattttagacctttgttgcaaacttcccaatctttgattaaactcttccaaatgaagctagtgtattttaggttctttttggaaccgtaaagagagtagagagtttgagaccaggatagaagggggttatggatagctctccaagaaaagatggctagggttacccgatttttctcttttgctgcatgtgtcacgacccggattttccaccatcgggagtcgtgatggcgcctactgagggagctaggcaagccaacttagcgagatcacaataacttaataatttaacaatatgaatttaaagcggaagaaataaatgcggaagtaacaacatatatagaatataacataacccgaatgcggggtatgattcaactactgacttctacccagaacttagtgtcacagtatccacagacgtactaggagttactacaaataatgactcaaaggaaacaatgtcatgaattacttgtccgaatacaatggaccaaatagcaaagacagaagagactaaggacccacggacgccagtgagctacctaatagtctctggactgaaggcgcgctcccgatctactgctggcactgctgtccgaaagctgctcccgtatctgtgcacaaaaaggcacagaaagtgtagcatcagcacaaccgaccccatgtgctggtaagtgcctggcctaaccccggtccacgaggtagtgacgaggctagaccggacctacagcgttaacctgtacagatatatatatgtgcgaaacaggaaaataatgcatgaattaaacaagtatgggaggggacatgctatataagggggaaacagttcaaataaatgaaaatgcgactagctaaacaaataatcaataaccgacaaagaaacacatatcaagtacaagtggacttcagtatatcccgtggtaggcgtaccacccgccctcatttagatcacatctcgtggtaggcgtaccacccgccctcatttcaatatgtcttgtggtaggcgtaccacccgccctcatttcaatatgtcttgtggtaggcgtaccacccgccctcatttcaagttcacataagacccattacggggaaaaacacaaacaattcacatatacttatccaacccggcaaggtatatagagatcatttagaatttaactcaagtagacatgatatttcattcaactttccaattaagccatttaggtaatatgattccaacaagtcattcacaagtatcaattcaatagctaaattccataacatagctttcaacaatcttaaataaagactcacggtcatgttttgactcgggtgcatagataaccgtcaccaaacctatgcaccgacccatataacacatagcaaataacttcctaatcctaatccctcgaactagagttagaacaaacacttacctcaatgccgaattagcaattcaaagctctaccaccgccttccctttggaatccaactcccaaacaacgatatctagtcataaattacccaaacgaattaataaatgctaattaaactagtttgaatgcataaggatgagtttcccaaagttttacccaaaatttcccaaaacgcccccgggcccacgtggtcgaaactcgaggttcggaccaaaaccaagttacccattccccatgaatccatatctatgattggaattgaaatcggacctcaaatcgaggtccaaaagcccaaaatatgaaaaccctagtttctaccaattccaccatttttgacccatgaaaagctttgattgatgaagaaatcatgttagatgatgatgatgattgaagaaattgagtaaaattagacttacaaacgaattggagaagaaaggttgagaggaaaatcgcctaaggagtgttgggtcttgaaatgttataaaatgaagctcaaaattcgtctaagtatagatataacaggtgcagatctcgcatttgcgagatacaggttcgcatttgcgaaccagggcagaaaagggagaatctcgcaaatgcgagtaaaacttcgcatttgcgaagaagctggctaagaggaaagtctcgcaattgcgagaagaacttcgcatttgcgaagtgaagggaggagaagcggaagtcgcaattgcgacaaaagggctcgcatttgcgaagcacaagaggacaggggggtttcgcatttgcgaaacaatggtcgcatttgcgatggggaagcctggagatgggcaggtcgcttttgtgacgactacttcgcatttgcgaagaggaaggggaaagcaggaggttcgcatttgtgaacgaaacatcgcaaatgcgaagaaaacaccagatatcagatttctaacttgaaatgttccgaaccacctccgaaaacactcccgagccctcggggctcccaaccaaccactcacactaactcaataacaccctacgaactcgcttgagcgatcaaatcgctaaactaacatcaaaatcatagattcggaccataaacttcataaatctcaagttttaacttcaaattctcaaaatagcttttcacatccgaaacacgtcaaacgacgtccaaatcacatgaaattttacagaaagtgcttaaacgccatataagacctgtaccgggcatcggaaccaaaatacgagcccgatacgacatttaaaagtcaatttttcattttcaaagacttaagatattttcagaaactattttcacagaaaattccgtatcttgggcctgggacctcggaattcgattccgggcatatgcacgagtcccaaatttaatgacggatatttagaaattgatacgacacgggtccgaacccgtttgcccaaaatgttgaccggagtcaactatatcatcattatacttgaaatttatcattttaagctaagaattcatttttcaatatagaaaatctttctggcttcgcgcccggattgcgcacgtatatcgaggcaacctctcaagaggttttcgcggcctcagaagcacggaacaaggagcatttatggtgatgaccccattgggtcgtcacagcatgaatgccaataccaccattttttttagtttttgtaatggtgtcccagggtaataggtgcagtttctttgaagtggttgtggagccccaaatgaatctcttttgaattttttcaatatttttaagaatcttgcaaggtaagcaattatattgcataacatgatttgggatactatttagagaagagtttgctaaattacttcgaccagctatattaagaaactttgatttccaagaggccagtttggtcgacattttgtcaatgataaattggtaatcagaaggtcttggtttagtgtttgttatagggaacccaagatatttaccaaagaaagtgctgagttgaatattaaaaagctttgacaattctttcttaatatgcacaaaacaatttctcgagacaatgagctttgatttttcaaagttagttttttgtcctgaaagggtgcaaaaggactcaagacaattcagaatggtgctaggagatttattatccacattacacattaaagtaaggtcgtccacatagaagagatgagatattttataaagcttgtttccaaggctgatgggagaccaatttccaatgtctacttggtgattttattaatggaaagcattttcaggcaaagaataaatatgtagggggatagagggtcgccttgcctaattttcctactaggagtaaaaaaattacttctacttccatttgctaacactgcaatgttactagtggtgatacattgcataattagagaagtcaattttttgggaagttaaagtaacaaagggttctgtaaatgaaggactattcaagccgatcaaacgccttttccaagtcaatttttaaaatgagagtagtcttgccatttttttgcttatgcatttttaaaataatttcttgaatgataatggcattatcactagtacgtctacctttaaggaaactagattggaaagggctaatgatatcttgtaagaaaggttttagtctatttgcaatagtttttgttagtattttgtaaatagtgttacatagtgatcggttcgaactctatccgaagatagagtgggctcgataactaataacccaatagtatatcggggtcgaattcctcagggagcttcaagattggagttgagtaattgtaggcttagagatgcgttctaacttcaaattgatcttctaacatttttggttttcttttataattatcaactacaattaacaactagtatgataatctagaattaagctaatatgattgatgctagaattaaactataagagagaggcactagggtcgtgacactcacctaggcggataatcaatgagtataagattctaatacaaggatgctaaatatggggaaagtggataactgttgcacttttagcactcgctctcacacctctcggtagagaaaatgatttttcccaattgactctctcgagaccaattgggtaggccaattttcccaagcaacacaaggttcaagtagggtaattactctctcgaggtttaacccgttacttgggactaccattctcatgggtccatcccaaatccttgttgggttgaatgtgagatcatagactctctttctcaagaagagtcaagacccactaagcttgacttagtgtttgcaaccaccaaatcataataaaaacatacacacaactcaaatccaaacacccaatcaacatccaaatattaagcacacacacccattaatcacccacactagggttgagtcacaaccctagctaatgggcttagctagatatggaagaaataaaacaagtagaaataatagaaaagatgaacatattcattaattaattgctaaatctactcaaatccactttagctacaagagaagttgcctaaaataggctaaaataatagctgacgagcgcagctgcttgttcagaacctcaaacttaacctaaaaaagtaaaatgttctatttatactacacagaaaaaattggacaaaaatacccctgagggtcagatgcggaccgcacagaaatctcgtgcggccgcctaggttagtgtgtcttcacttcagctgcttctgaatcaagagatgcggtccgcacagaagtgcactgcggccgcgttggtcttgtcaggcgagccgcacagaaatgcagtgtggccgcataggaaaaatcaggcggaccgcacaaaactggtgtgcggccgcctaagaaggaatgccagaattgctgcttctctgaacttgctcccacgcggtcagcctgcttttggtatgcggccgcgtgggacttgtgactgaaagtcctggcttctgagctttgatcaggcggaccgcacagaagtgagtgcggccgcatgggtcttccttcaaaaatactgagtctctgaactatcttattgcggccgcacaccatagtcaggcgggacacactggtcttgtggagttttatcaagtctctgaactatcctgtgcggccgcacaccatactcaggcggcccgcacatgttccttggcttccacttttcgtcaacttcttattacttggcaggtttcactccttcttgagctaatttgtgattttcatcatcttgtcgctcaaacctgcaatcaagcacacttgtaagtaattcaggactaatcagaggcaagttatgcacaaagctaaggtaagaaggggcataaattatgtatatttcacagttatcacatagtccgataggccgaatttttttgagagatatgacattatggacttcgggaattaagcaaagataagtgtcatttatacctgtagggagtttttctagttcaaaagcttgttggcaaagaagtcactgaggtatttaaaatgtgctagtatttttggaaaaaaaaggggtgaaggccatccggaccgggagatttgtaaggattaaaacaaaacacagctctttttaattctgattgggatataggataatctaaagagcttaagttatagttgaaggaactggagtgatctttgttaaaactaggccgattggacattttatgatttgtagtgaagatattcatgaaaaaagtgtaaacatgatccaatatgccacgagggtcatcaatccaattaccatcatagtcctagaagtagactattttattaattctccgattgttggtggcacatatatgaaaaaatttagagtatgaatcgccatcattaagccaatttattctagagcgtaatttccagtagtcttcttctattttaaggagatcgttatactcgttcttaagggagatttctaggtttgtgaggaaagaactatagccataactggatgatttttggatacccgataatctagctaaaagagtccttttttatacgatttccaaaggtggtggatttccaatcagtaacttgatgtctaaaaaagatttgaggcttggatatagttattcccatcccaacaggtattgactaaattctcaaattgtgggtgtctacaccagaaggtttccaacctaaaaggcttagggagatgatttgagtatttaggaactaattctattaataaaggagtatggtccgagtgagtttttggtagatgaatgatgctagccctaggaaaaatattaagccattcatcattagctaggacctcgtcaagtctttccattatacgagtatttttacacttattatgatttgaccaagtaaatttgcaacctttgaattctagatccattaagttacaatagttaatcttattccacaatttaatggcccttcttctattaattgggtttccccctaatttatcttccgctacaagaacatcatttaaatctcctcctaagagccatgcccccttataattataaaaaatgttagtaatattgtcccacatgatgtttctcttagcaaccttagtactagcatatatagtagtaaaaagccaagatttttgagaggggattacctcgaggagagcatggatttcattgttattcttgacaaagttgttgacatgcactaggttagtattccacatgacagccatccctccagattgaccctcagccggaacctctatcatatccgtgaagccaaactcattcattaaactaccatggctagtcattctcatttctaggagggataccatacaaggctggtgtgtagccataagttcatgaaaatttctcttaaaatcagaattgttacctccccaaatattccaaataattattttcttagcacaattcatgggtggattgttgggatgagcatggccattggcctgagatgattttgggaatattggattcctccttagagaggggactaggatcatggctattttccctattgttggatcttgaggtggcctcatgtccattgtgcacttgaacagtgaaggtggacaggctagaataagcctcttctctcgcctctcctcgaatagatagactttgacctcatctaggtttgaagattctgttatgtgctcccctataagatccatttcccctaccatttcttcgcccccagatttcctagattttgaggcattgggggatcttggaactgatgatccatttggactggaatttgaggcccctcctattgcatgggattgagatccatttcccattgcatcagactagggttcagggccattagttcctggggagggaaaaaaggggagctccagacctagattttgagggaggtatggattctgaggaaactggggagggaagttccattgtgccctcatggcttgaacaaggttgttgttcatccccggggctaaaggctgcataatgttgttcacccaaatgtgatttaggtagttgttcattgataggtggagaccctccgaaattacttgggctaggaattgtgggttgtttataaggatgatactctcttggccattgattgttacttgtagtgatatccccctccccattaagcctagctctatccaactggtgggatggtggttctgaggtagaggaggttgagcatatattactaggatcgggtgcatttgttgagacaagggtggtaggttgtcgattggtagagcttggaggttcctcaaaatttggatgaggcaaaatctccttcgactgggttgagggtctctaggcattttatgggtgtgaattctgttgatataagggctggggagtaggtttttgaggaatgatggggtctatttgcatgcaaactggaagggttagcgtgcttgaaaatataggatattttgcatgggattttgttggcacgtggttttggtcattatcgacgccccctttttcctccctaaaggaaagagcaaaatcgggtttacgacattatggacaaacacaactcttattcccttttggggaatcgggtcatggaatttgaagagtcgccacctaatgattatagtgcattaggacattttaaagaagaaaaagatattttgaaagaaaaccagagttcgggtaagggcttgagattatctcgaggggaaggtgttaggcacccctcaagatccactagtgtgattcccgattgtgcttaattgtaacttttgaagaagtagaaagaaacaagtaaagtttgcacataacggttataaataaatattaaagattttaggaaagaaaggttataaacaatttcttaaaggaaaaggagtaagtagaagaaaatataaatttaagaaaacgttatacaaaataaagaagaggaagggggtcctaggtttaaatataatatggatcacatcggtacaataccccgcatacactcctcaagagaggggtcgcctatgataatagcgcaccggtcatcatctccatattctacccttcccgccccgtaaaggttatttaaacgtgtgaattggtcacgagtgcttattgcgtgctattacccgtcccgtcctataggtcctagagggtattttaggaccactattcctataaggtgaggactaggtagaacccttaggtttaaaggtcaaaacactaggcgacatacaaaagcaaataggacttcatgtaagggatcacataaaggcatgtaaaaggctcaaatatccttccacggatagacatataattaggacgcctcaatcacatttaaggtctaaggaaatgagagttaaaagctggaatgttcgaaaataggttaaaatagaagctgaaaagtttaaacggaatttgcataaaagagttggacggaaactttagaacatgaggaaaaggcagtaaatacgtaaccattcataaatcagaagaaaacattttttaaacatactcgaaaaatatatggtaaattataacagatgtagtattctgcaaagggaagaaaatagtttcagacagatgtaagattattcagtattgcggaagtataaagaaagagagcagtaaatatattagtaccttttgaaaattacaaaagacatagtattctaataggttttagggaaaacaataacgcaattctggactgaagaggtaactcagtagaaaatatgtgacacgggtatgattatctaaaacaggacaaaagtttagtatgaaaaaccagtaggatctcagggaggccgaattcagagaattaacagaaactgattagcttacaacatgattaaggtgattaatcgattttatccggcctaaggcttgcctaggcgttgtttgatcataaaagaaagtggacatgcatatttgtcttccaaattttaaaagagaactgttaaccaggcttatgtggttgaacaaaactaataaagcgttccaacaattgcaagtggaatcctaattgcatgatatctaatgcacataatcgtcctaagacatggtatctaaatgcagtagtagtacttgttaattattaactgattgtagttataaagtaagtagcaagctgagagtaaaagagcttaaagacaggatctctagtcatataagatgtttgccctagacatggtttctattgcacaagtagataagtaaaatcctataggcatgttttctacccattacttaaggctaagcatgcataattccacccaattttcactatagcccccaatcgttctttacaaattattacagaccaaggcaattaaattacagtaatgaagagtaaaggaaaaaaataagaagctattctatagggagccttcagccaggcccaagtctccaacctcacttctttcgagtttcacagcctttcaccaatgtttgggtgcgacaaagttccctaagggcccattaggacccttggccaataccaggcacccaaaacaaattgataagtgcaagtgtggaattaccagtcttgtgcatcaaagttccatgggtactcaaggtacccaaagcaatgcttacactaagggggtaggacctaaattctaggagtagtgggattgtgatagagtttgaagaagttgagttggaaacagttgaaggtgggtttacatgaaaacaattttgagaagacagtaacagaagagtgagagtccttttaaaatcaattgaagatgatttatatggaaccagttttgaaagcaaagagtcatacaatattcagggaacacaaacaggggcagggaaaagggaacaaataactcacaagcaagggcacagttacacaaaacattaaagagaagtacttcaggataatcaagcatgcttcaaacaaagagtctagttcttacagcaccagacaccaaacagagttaacatcagaaagaaggttaggtctattgagtagccaagagggtcctgaacacatgctggtagtgtacaggagtaaggagaaacatacattgggataggaaatgagagtaatgaacatgccaggttaagctaggcatactgatcaacaccgagactgtcacgacccaaaaatccccccaaaagagtcgtgatggcacctagtctctaaactaggtaagcctaacattaactgaaataacatcgatatttatcaacttcaaataaaattttctctaaacaatttacaattcccaaaatcggtagtataagtcacaagcctttctaagagtagttatacaatataattatatcattgttccgaaacaaagggaacaaatgaaattaagtacaattgaaggtgactctgaggactgcgaatgctatagcaggtttaccttgagtctccaccgtgtcgaatagctaccatcgatcaaatgcatggatctgtacacaaaaatgtacagaagtgtagtatcagcataacagaccccatgtgctggtaagtgtctagcctatcccggtgaagtagtgacaaggctaggactagacactcacataaacctgtgcagtttatagcgtacaaaataatatgaaacaaataacagtaatggcaacaatgatcaaccaatgatataaatatcatgcaacaagaattccaaaattgcttctcaacaattaataaatacaggtgcaatcaattaatcgagtccttgaaatataaatctttcgcctataaatccttcaagtaataatctctaggataatatgctttcaataaatatatttcaaatatatttctttcaaataagtatctttcgaatgtaattctttcgggtaaaggtcaccttgtgacgcctcatttcaaaatcataataatatagtctcggcccactttcatatttttacggcatctcgtgcccatatttatattacaactgcacggacaactcccgtgcaattaaataaaactataatattttttccggcaccttgtgccaaaatatttctatttcacattgcacaacaatattctcatgtgactcagttcacagggcccataacccaatacaattaagaatgttcaacgagcctcatttacttaacataaagtagagtacaacttccaacccaattaagaaatcaacaagaaaagatgaagttatttttagtaatcatttgataaagaaaatacccttttcaattaaactacaattattgaagcttgaagtattgaactatatatctatatatataaatgcggtgcaataatgcaaatactgtaggttctaacatgaagggtcacaacagtaaaagaattcaaacagtttaaacacttgaattgataacaacaaataaacacagcagtagaaagtgcacgacatcaccattataaggaatcaaactccagccaccaacaagaataaggaaaacaaaggtagatttcactttcagatcacatctcgttgcaagcgcaacccgttccaatctcatttaacaccattgcggcgtgcaactcgatccttattataccgttgtggcgtacaactcgatccgtcccaaatgcacaaggtcctgccaagggaatacaaccaacagctcaaatatcccggcaagaggaacaataatattaaacaaacatcccggcaagggaacaatactatcaaaacaaacatcccagcaagggaacaatactatcaacacaaacatcctagcaagggaacaatactatcaacacaaacatcccaacaagggaacaatcaacacaaatatcccaacaagggaacaatactatcaacacaaacatcccaacaagggaacaatactatcaacacaaacatcccaacaaggggacaataataataataacacatgaagcacaataaactataacggagtcataacaattataatacaagactcacgggcatgctcgacccccaacgtatagatactcatcaccatacctatacgtcggacacatcacataacaagtagcaaatatactcaactcctattccttcaagctagggtagaccaaacacttacctcttttgaagctaggccgatattccaaaatagcttttcttgcttgaattgacctccgagagactcaaatctatccaaattaatagtataacttcattaaaatacatcggaaacaattccggataataaaatattgacttaaaaattcacattaaaaagtcaaccaaaagtcaacatgggacccgcctctcaaaacccgacttaatttcataaaatccgaacactcattccaaaacgagtccaaccatactaattttatcaaattccgacatcagattggctttcaaatcttaaatttttgcttttggaagacttggtaaaaaatctagtttttcttccatgaattcatggattcatgatgtaaatgagtatggaatcatgatatataaaggatttatgataaataacacttacctcattcaaatttgtgaaaatccctctgaaaatcgcccaacctaagttctcccaactctatttttgtcaaaaatgaccaaaacctccgttttattgagtttttcggattcgggcgccacaggtggcgccgtgcgctgcctgtggtgctggatccagtagcctagaaaaatctcggcgccatggatggcacccggcgctaccctgggcgctggcgatgggcaattaatttttccgacgcgaaaatgggcataactctctcatacgttgtccgaattggacgattctttttgctatggctccgaaatttcgatacggatctaattattcaatcaaaactaaatttggagcttatttgcataaaattataccacttattcttgaagaacggtatcaaaacattcttgaaatgcccaagttaaactccaataaccatccaaactccacccgaggccatcaggacctcaaccaaatatatcaacaaatcctaaaatatcattcggacttaattagagtttcaaatcatgccaagcaacgttggaactaaattcacacatcaattcaaacttatgagtttgaaacttttccttttacaaagcgcgtgacgaaacgtatcaaatgaatccgggatgacttcaaattttacatacaagtcattaatgacataatggagttgttcaaatttttagaatcggattttgaccccaatatcaaaaagtcaactccccagtcaaacttttcaaaaatcttctatttttccaacttttgccaaaatgtgttaaattgtcctacggactttcaaatccaaatccgagcatatgcccaagtccggaattgccatatgaagctattgaagttataaaaattctattccggtgtcgtttgctccaaagtcaaactccggtcaactcttttcatttaaacttccaaaatgagagttattcttttatttaaatttcgaatctttcaagaatcaagctcgaccacacatgcgggtcataatgcatattatgaagcttctcgaggattttaagcagttgaatgagatgctaattcttaaaacgacaggtcaggtcgttacagagacatactaattgtagtaagaacaacagaaccataagtagaagcacacaagaaataaaaggaagtgcaacacaaatagaaacatattgctttggagttgtaaatcaaataggggacataccagttgaagataatgtaatatagagcagtagtgagcaatgatatgcagagtagtgagcaatagtgtgcagagaatatgcagagaggtgagcagcagcaggatgagcagtagtatgcactatgcatacccaaaatagagagcaatgtaaagaccaatagaacagcaaagtagcctaagttcagcctgggttttaagccagttgagtaaccaatagtcacaagagaagtgggagggattgtgtggaaacaaagatagaatactaaatatttcgagagagagagagagttcagaatgagttctgtgtctgtgtcaagtgagaagagaaggggagtacttatagtttttgaaaaacaatagagaatagggtaatgattatataattatagaaacagtaccagatcgaatcaatcacagaaccttaattcatttaaactagggtttcattgattcgaatgggagtgcagccatatcagataaggaaagaaccaatcagatgactaattacaccacagtgagagtaataggcatgctgcacataataaaggctaaatacatgatgctccaaataagaaaaatatatattgagcatttgagcaatatatttaagtacacaaatatagtaagcatgtaaatcaactctgaaattagtcaaagaatccggacaagaccaaaatcagagggaatcaacaccaagtatagaaagcaactcacaagtaaggaaacaatttggaaaatcagtgtaagaacctttaaggaaaacacatacaaattagggattcaaaaagatgcacggaattaacagaacacttagttaagagaagcatttaaacctatttaaatacaataggcacaaaaccaagaaccctaagtaaggaatcacataaacagtagagagtcggaaccgtagtaaagatctaatgcatggaactcagaaacaaacaggcttgcaacataagcaaacacataacataggcgtacatagcactcaaaggaagcaaagtatacaacgattttaaaaaggggtcagaaaccctagcttttgagaaaagaaacaaaaacgtttaaaaactcgaattaatcgaagaaatcgggtaatgagtagtgtaaaataccaagaataactaaaagttatttcaaaagtcagagattaaaagatttatgcaaaaatttaggggttttgcaataaaatcagtgaagtaaggaacttagccgtgaaactcgttaacaatgaagtttaaagcatcatcagaccaaaatccatcggagaaaggccggaaatggacctcggcaaggcttcagtgaccatcttgcatggtggaagctcctggaattccaaagatgaagggaatcggtgagataaggtttcacggtggcagatggtcgaaagaggcgaggctggagttggccggagagggcgatgagagccatcagataaggtgaacaagaaggttctagagagaagaaggaggtgaagagttttagagagagaccggtctcttttcaaatgagggtaaagagaaggggggtcgtttgatttattttaggcaaattaatctggctcgttgatctcgtttgatcaacagctcagattaaatgatagctggaccgggtaaattaaatgggtatgggtcgggttagtttgggatatgggtcgtccaaattggatttaaaattgggtttaatttgggctgtgttgggatgtaattttggctacaattgcaatgaaatctggccaaattttaaatagccaatttctctcttttttaattaattaaaatagttaaaagcaatttaaaaagccaattaaacactgaaatgactaataatatataaacaacaatctaaaaatattgtgaacaattttttagttataaaacacggttaattgtaaaataggctataattgcaatttcatgcaatttagctttagaaatttcaaataaatttgtaaaaatgtgccaaaattatattaattatattttgttgcaagtacgagagtaaaatacattattcaccaaaaaatgataatttggaaataattttggattttgtactgttaaaataggcagtaaattaattttaaaaaatcttaaaaatcgaggaaaaataccaaaactctcaggcatgtttatatatgcatacatatgctattttgaaaataatttgagtatagaaatatataggaaaaaaattgggtatcaacagtcatttgccatttggactgtttgagaggggtgattgggcacttggctatccgcatgcaagggaaagggggctgtttgggaggatttattatttggagtggagggtttgttaaaatcatcatttgtgctagtctgagtgtcgtatgattgggttagaggattatttaggtgataattattattaactaaagatttgtcgtgtagtggctgagtatcttttttaggggtaatagggttctgaacccggtttagaaccaaggtggttactgggttattaagatctaaagacttaaaactttcagggtcagatttatgaggtatttgagatggagtagagtaatttttagtggtttttatactaggtaagggggtttgggtagggggtgtttgatgattaaatagaacagtattatcagtctttgtaataggaatttttggaatatatttaaccacttttgaagtaggaaacttacctagatgctgggacagagacctattttgattaccttgtatatgatttttgcttgaagttacctcttttccttcaacttgttgtgtatatttgcgtctgggaaaagacactgtctgccatccgtcatttttagtgccctttactaagcatttcacccccatttgttgagtgtgatttggatccgcattagatagatttatccttacacaggccagctctttgtgccctaagtaaccacagtttttgcaaaggtagttgtccgtttcgtattggatttcctgtctatggctgccgatgaaaatgtattttttgactggttcatccattggaacctcaatgcataatctcgcatatcgtcctcttaaggatgaggatgtgcaggcgtcaatttttaataatttcccaatgaattttcccacccgttgtaatatttggttgtcgtaaaactctgtgggtagttgaggaagtcttacccatactgccgtgtgactttgtttagcatcctttgcaacaaaatttggttgccattgttgagttgataagaaaaacccatagacaaaccatggaccatcctgaaggatgtgggacatgttatccttgttttgcagctttactatgtagtagtcattgcctagatcgatgaggggaaaattttcttttaatttccataggatctgtattttgtgtcttagtgtttggtggaaaattcgttttccatgtagtttgatgattgggaaatgcttccatggaaggtagatacgcttcttgtcttccttagtaatgggaatcgaaagggtttgatctccagttaggtattcgaaagaaggagctggttcattctcttggacttccataggagaggaatttgaatctatgcggtttaaaaaagaaataaaagtcaccctattcccaatgagtttatctttgaaatttagtggggagtggatcgtcaattgttttattttcaatgtccatttgatttcttttagatggagaagggagatgaagagaactggaaattttccagagagatggaagagcctctctcactaattagacttggttgtaggcggaaatatctcttgacaaaatttggaaatgctttttgtaataaaaaatgttgaatgaggaaacgtaattggtaaagagaggaaacactcaaagtattacaccctattaagtccaattaaacttgcataaaacaaaggaaaattttcataaaacactatcttttagtagtaattagccatttatagataccatttgctatattacggattatagataccttttatgttgttataaaatgtatttggtgtatttaagctattgtattcatgaatacagtagcaaaaataggcatgaatcagggaagtccagctaatcagttgttatattcgagtgtattcgattgtattcatggagtgaaacatgggattacagctggacagattattatattcgactgtattcacggcgtgaaataggggattaaactatttttaaaacggaaagtgaatcaattaacataatagactcctaatataactcaacaaactcaatcataacacacaaaatttgtattttcagttataaaaaagactctcaaccaaaaaatatcccaaaaacatagcaatcttcagaaaaattatataatatatctgaatacataaattatattaactaaaaaaaacttatgaatacattcagggtatatagcgagatagtgaatacgatgaaatacatagtatacaatgggatacattcaaatacaataaaaaaagacaaagaatacaatcaaatatatggaatacagcgagatacattgaaacaatgaatacaatcaatatcatgaaaatacagcgtaatacgttgaaattatattgaaatatattaaaagaaatgtttgtaatgacccgacccgtcatttcttatatttcagcccgttatccccgtcatatgtttccccgcgtgttgttatgtgtattcggggagtcgggaatggtttggattggttttggataggaataggttgaggagtccctttatgagaagcttaagttggaaaagtcaacccgacgttgacttatgggttagagggctcggaacggatttccgatggctcgactagtttcggggtttgatttgcgacttattggcgaaagcggaagtgaattcggagttccggagtgaaagttagctaggtttggcgaagttgaaaattcggaagaatccggttgataggtgagaatttgatccgagggtcaaaatggaattccgaaagttgcattagcttcgttaggcgattttggatgtgtctgcaaattttcaggtcatttggacctcgtttgggcgggtttttgattggatgagatttctagaagtttaagttagtttggaattgaaattgttgagttttggtgatttttgatgtttatgatagcgtttttatggcccgagcaagttggaatgaagtattaggttgaggttgtgcttttggttgaggtcccgggggcctcggagtgatttcggatggttaacggatgagttttggtgtttggaatgttgcagatttggctgttctgatattgcagagaattaaccctatgcgatcgcaagggtgcaatgcgatcgcatagagggtctgtgggaggtttgctagttggtctatgcgaacgcagtggagtagtgcgtccgcaatgatggatttctggaggcccaggttttgtactatgcgatcgcaggactggtacgcgatcgcatagaaggctgttggtgaggttgggggattgcattgtgcgaacgcataaggggtatgcgaacgcatagaaggattttggagcggtggaagtttgctctatgcgatcgcagggctgtgttgcgatcgcatagaagggcgcatcggtggtcttttaaacataagggattatttcatccgcgagcttatttgatttccaccatttttaagagaccttgagagctaagtgacggattttgaaggggatttcatcgggagttcattggaggtaagtctcgtggtcctaatacgcctttttatggaagaattaagcctaaaatctctgaaattgggtaaaattaaagaagaactagggcttgagttttgaactttaaaatgatgatttggaggagcaaatggactccgattttgatgaattttatatgaatggactcgtggcgagacgagggtcgttttggtataaagttttctggttttcgaggtgtgggcccggggctcgggttttgctaatttcgtgatttgagttgtttttcgagttctttcgattgggttatgttcccttagcattatgtaacatattcgttgtggttttggccagattcgacgctcgtagaggcggatttgaggcaaaagggcatttcgagctagtctacggccggctagaggtgagtaatgctagtaaatgctgttctgagggtttgaaaccccgaactttcacatcgtaacgctatgttgaggcgtgactcgcactcctggataggtgcggagtcggatgttgttggggattatgtcttggtccatcccgagtgagattctatagtaaattgacgtatgatacgcgtactgtgatgattattattgggctatatgccgtgtttggggcctagtgccgacctgtgatactcttcgagagtggatattactgtttatcatgattgcatatcattcatatcagtccatggctttttaaagcattgttttcaaaacccagccgtatttcaaatgttcaaactcacatgatatcttttaaaatatatttcggctgaggatcatgacttataactgcccaagtggcttgtgatatattttctagactgatattggttggctcgggctgcacgccgcagcggtgattggaccagtggtaacatggacactgtgtcgtatgagcggtcaggtaacatggactgaccgggttattgatattgccaccacgagatggctgattattgcgcttgggctgtaggagcccctccggagtctgtatacacccccagtgagcgccgtcgatgataaatgaaatggttggctcggactgcacgccgcagtgggtaccggagtgtaccagcatttgcattgcataacatccctgcatttgcatcttacttattgttccgctttgctcggtttcagatattgttatatatactgttctttagcattaccttgtgcatttctgtgttttcttatcttcagactttatttactgttattactcactgggtcggagtactcacattactccctgcaccatgtgtgcagatccagggcatactcaggcgggctagcttccggagttctcaggtgacagcttggagcgttgaggtagctgcacggcgttcgcagccatcgacccttcctctatccttactttcctttttggttattgcactctcagttttcgaacagttgtatcagattatcatattactctagaggctcaaacttgtgacaccggttcctcggtggttttgtgggatattttgacttccgcagctttactatctgaaatctcttcttttattaagtattgtggatataattctgttgttttgggaaatgttggtattgtggtcaggcttgcctagcctcacggccgggcgccttcgcgatcgagatttggggtcgtgacaacttggtatcagagcctaggttacttggtctcacgagtcatgagccggttcagtagagtcttgtggatcggtacgtagacgtccgtaccatatccacgggaggctgcagaactgttaggaaacacttcacattcttgaaattctgtcgtgtgatcttattgatctggaaactaaattctactattctattctctcgcagatggcgagaacacgcgctaccagaggtgccggacgaccaccagtaccacctgccagaggccgtggacgcggtcgtgggcgtggtcgaggcagagccacagcggcagcacctattgatccaccggctgcccaggttcaggatcaggcaccgactgtgcccattttcattccgggtcttcaggagaccctggcccagatactgtcagtttgcaccggcctagctcaggtcgtatcagcttctacagcagcagcagcatctcagtcagggggaggacatcaaacccccgctgctcagactccagagcaggttgctcagggcttgcagacccctgaggcagcccctattgctccagctccacagattgctccggttcagggagttatggttccggctatgccagaggacgagcagcgtcgtctcgagaggtacaacagactttcgcctccgactttcagtggggctcagggcgaggatgcctagggatttctcgacaagagtcgacgtatgctccagactgcagggattttggagactagtggtgtatcattcactacctttcagttttcgggtgcagcatttacatggtgggaggcatatgagcggcgtaggccggcaggagcagcacctttatcttggctagagttctccactctcttcctagagaagtggatgccacattctcagcgagaggagctgcgtaggcagtttgagtaccttcggcagggtgatatgacagtgtcacagtacgagatgaggttttctgagttggctcgtcatgcgccatggatggtcccgactgatcgggtgaggatcaggagatttgtggacgggcttatctatcctattcgtattttgatgtccagagagagggttctgagccatacctttgaggatgctggtgacattgctagggatattgagatagatcgtcgtctggagagagaggagagagaggccaagaggcctcggggatcaggtggtttcagtggtgctccgtctaggggccagttccagcagggcagaggtcgccctttcaggcagcagcagccggcccgtcccgagtatcgcggggcatcttcaggccgtggtcatcagggttcacagcagggtcagtcttcgctgagtgcacttcctgcacagggttcctcctatgctccatcagctcagggttcttcagcgccgagtagatcggcgggtcattctggtgcgaggggttcccttcagtccccttctccagctccaggcagttgctatgagtgtggtgagtttggccacatgaagaggttttgtcccagacttcatggtagtagatctcagcagagggaccgaccctcatcttctgcaccggtttcatctgcttcccctcagtcagctagggaaggtggtcagacaggtagaggccgacccagaggtagaggccgctctgacggtggccaggccaggtttcatgctattccggacagagccgacgctattgcatctgatgcggttatcataggtattattccagtttgtcaccgagatgcttctgttttatttgatccgggatccacctactcttatgtgtcttgttattttgcccatcacttgggtgtggttcgtgatatttttgtctcacctgtgcatgtatctaccccggtgggggatacgattgttgtggatcatgtgtatcgatcctgtttgattatatttgggggtctggagacccgtgttgacttattgttattagacatggtggatttcgatgcgatcttgggtatggattggctgtccccgtgtcatgctcttttagactgtcatgctaagacagttacattggctattcctggtattccccgagtggagtggcggggcgtgactgattatgttcccagcagggtgatttctttcctaaaggcccagcggatggtagggaaaggttgtttatcgtacttggcttttgttagagatgttggagctgagactcctagtcttgattcggtccccgttgtgagggatttccctgatgtgtttccagctgacctgccgggcatgccgccggacagggacgttgattttgggattgacttggtgccgggcactcagcccatttctactccaccttatcgcatggcacctgcagagcttaaggaattgaaagatcagcttcaggaactcctagaaaaggggtttattcgtcctagtgtgtcaccgtggggtgcacctatgttgtttgtgaagaagaaagatggcacaatgaggatgtgcattgactacaggcagttgaataaagtgaccgtgaagaacaagtatccattgcctcgtattgaggatttgtttgaccagctccatggagctaaggttttctctaagattgatcttcgttctggctatcatcagctgaagattcgggattctaacattatgaagacagctttcaggacaagatatgggcattatgagtttctggttatgtcgtttgggctgacaaatgccccagttgcattcatgcacttgatgaatagtgtgtttcggtcctatttggattcttttgtgattgtgtttattgatgacatcctggtgtactcgcgtagccaggaggagcacgcgcagcacttgagggttgttttgcagaggctgagagaggagaagctttatgctaagttctccaagtgtgagttctggcttagttctgtggcattcttggggcacgtggtgtccagtgatgggattctggtagatctgaagaaagtggaggcggtgcagagttggcctagaccatcttcggccaccgagattcggagtgtccttggtttggcgggatattaccgcaggttcgttgagggtttttcatctattgcgtcgccattgactaaattgacgcagaagaatgctccatttgtttggtcggatgagtgtgaagagagctttcagaagctcaagtcagcattgactacagctctagtgttagtattgccagcagcttcaggttcttatacggtatattgcgatgcttcgaggattggtattggctgtgttcttatgcaggagggtagagtgattgcatatgcttctcggcagttgaagccgcatgagaagaactaccctgttcatgacttagagttggcagcgattgtgcatgctttgaagatttggaggcactatctctatggtgtatcatgtgaggtgtatacggatcatcgcagccttcagcacttgtttaagcagaaagatttgaatttgagacagcggaggtggcttgagctgcttaaagactatgatattaccattttgtatcatccggggaaggccaatgtagtggccgatgccttgagtcggaaggcggttagcatgggcagtttggcgttcattccagttggggagagaccccttgctcttgatgttcaggcattagccaatcggatggttcggttggatatttcggagcctagccgggtattggctagcgtggtttcctagtcttcattgtatgaccgcatcagagagtttcagtatcatgataggcatttgcaggtccttagagatcgagttcagaggggcgatgccaaggatgtgactattgatggtaatggtgttctgaggatgcagggccgtaactgcgtgcccgatgtagatgggattcgagagatgatattggcagaggctcacagctcgcgatactccattcatccgggggtcgcaaagatgtaccaggatttgagacagatatattggtgggaagggatgaaaaaggatattttgggtcatgtggctcggtgtcttaattgtcagcaggtgaagtccgagcatcagcgacctggtggtttactacagcagatggttattcctgagtggaaatggaaaagaatcacgatggattttgtgactggtttgcctcggacaacgaggaagtttgattcgatttgggtcatcgtggatcgattgaccaagtccgctcatttcattccagtgtgtactacatattcctcgcagcggctggcagatattttcattcgggagattgttcggttgcatggtgttccagtttctattatatcggacagaggtccccagttcacttctcagttttggaaggcttttcatcgagagatgggtacccaggtggatttgagttcagcattccaccctcagacggacgggcagtccgagcgcacgattcagatattggaggatatgttgcgtgcttgtgtgattgactttggtggctcttgggaggaattcttgccccttgcagagtttgcttacaataacagctatcggtccagtatccagatggcgccttatgaggccttgtatgggagacggtgtaggtctccggttggttggttcgagcccggcgaggctagattattgggtacaaaggtggtccaggatgctttggagaaggtgaaagtgattcaggagcgacttcgtacagctcagtcgcgtcagaagagttatgcagatcggagagttcgagatttatcattcatgattggcgagaaggttttgctgaaggtttcgcctatgaaaggcgttaggagatttgggaagagagggaagttaagtcctcgatttataggcccttttgagattcttgataagattggggaggtggcctatcagcttgctttgccgcccaggttatcgggagttcatccggtgtttcatgtttctatgctccggaagtatgttgaggatccgtcccatgtgttggacttcatctcgattcagctagatgatgatttgacttatgatgtggagccagttgccattttgggtcgccaggttcgcaagttgagatcgaaggatatagcctcggtgaaggttcagtggcgaggtcgtcccgtggaggaggctacttgggagaccgagcaggagatgcagagcagatatcctcatttgttcattgatccaggtatgtttcttgacccgctcgaggacgagcgcttgttttagttggggaggatgtaatgatccgacccgtcatttcttatatttcagcccgttatccccgtcatatgtttccccgcgtgttgttatgtgtattcggggagtcgggaatggtttggattggttttggatagaaataggttgaggagtccctttatgagaagcttaagttggaaaagtcaacccgacgttgacttatgggttagagggctcggaatggatttccgatggctcgactagttttggggtttgatttgtgacttattggcgaaagcggaagtgaattcggagttccggagtgaaagttagctaggtttggcgaagttggaaattcggaagaatccggttgataggtgagaatttgatccgagggtcggaatggaattccgaaagttgcattagcttcgttaggcgattttggatgtgtctgcaaattttcaggtcatttggacctcgtttggtcgggtttttgatcggattagcattttgaaagtttaagttaattttgaattgaattcattgaattatgatgatttttggtgtttaaggtagcgtttttaaggcccgagcaagtttgaatgatgttttagggtgaggttgtgtgtttggttgaggtcccgggggcctcggggtgaattcggatgctaaacggatcgagttttggtgttgggaagctgctgaaaatgcagcagcagttgcaggctaaaattagcctacgcgttcgcgtggtggccttcgcgttcgcggaggcctggggttcgtaagccttcgcgttcgcaggagctggtcgcgttcgcgtagaaggctgagtgagcggagagggtcccaggccattggccttcgcgttcgcgagaaattgaacgcgttcgcggtgagggagatcagttgagcttcgcgttcgcggtagagggctcgcgatcgcgtaagaggaattttggctgaggaaaagttgtgcatcgcgaacgcgatgggtgtccgcgttcgcgaagagggacgcgtcagggcactgtttttaaaacttaagtgggtttgtccgcgagctcatcactttttcctccatttttggcatatcttgagagctcattgacggatttagaagaggttttcatcggaggatcattggaggtaagtctcggggtcctataacatcattttattgaagaatttctcattaaatctctgaaattgggtgaatttgaggaaggcctagggcttggtttttgaatcttaaattgatgatttggaggagcaattggactccgatttcgataaattttatatgtatggactcgtggcgagacgagggtcgttttggtataaagttttctggttttcgagacgtgggcccgggcctcgggttttgtcattttcgcgaatttctatgtttttcgagttctttcgattgggctatgttcccttagcattatgtaacatactcgttgtggttttggccagattcgacgctcgtagaggcggatttgaggcgaaagggcatttcgagctagtctacggccggctagaggtgagtaatgctagtaaatgctgttctgagggtttgaaaccccggactttcacatcgtaacgctatattgaggcgtgactcgcactcctggatatgtgcagagtcggatgttgttggggattgtgacttggtccatcccgagtgagattctatactatattggcgtatgatacacgtactgtgatgattattattgggctatatgccgtgtttggggcctagtgccgacctgtgatactcttcgagagtggatattactgtttatcatgattgcatatcattcatatcagtccatggctttttaaagcattgttttcaaaacccagccgtatttcaaatgttcaaactcacatgatatcttttaaaatgtatttcggctgaggatcatgacttataactgcccaagtggcttgtgatatattttctggactgatattggttggctcgggctacacgcggcagctgtgattggaccagtggtaacatggacactgtgtcgtatgagcggtcaggtaacatggactgaccgggttattgatattgccaccacgagatggctgattattgcgcttgggctgtaggagcccctccggagtctgtatacacccctagtcagcgccgtcgacgataaatgaaatggttggctcggactgcacgccgcagtgggtaccggagtgtaccagcatttgcattgcatagcatccctgcatttgcatcttacttattgttccgctttgctcggtttcagatattgttatatatactgttctttagcattaccttgtgcatttctgtattttcttatcttcagactttatttactgttattactcactgggtcggagtactcacattactccctgcaccatgtgtgcagatccagggcatactcaggcgggctagcttccggagttctcaggtgacagcttggagcgttgaggtagctgcacggcgttcgcagccatcgaccctccctctatccttactttcctttttggttattgcactctcagttttcgaacagttgtatcagattatcatattactctagaggctcaaacttgtgacaccggttcctcggtggttttgtgggatattttgacttccgcagctttactatctgaaatctcttcttttattaagtattgtggatataattctgttgttttgggaaatgttggtattgtggtcaggcttgcctagcctcacggccgggagccatcgcgaccgggatttggggtcgtgacaatgttcttcttcatcgcgaaagaaagaaatcgtcacttagtggatctccgaaattgaattctctttccacgaccgccgccatctccttgttggacttgaaattatgagaaattattcccatgttgaagttgatgaaaatcatgaaaattttgagtactcaaatgtttgcaccatagcctttgttgttgtttatgttggctataagggtaatgcatattcaaaggcaaaggctgagcttgttggaatgcaatgttagaccaaatatgattcgcgttcgcgccataactactgattgttccatttgtgagatgagatccaatggtttcttggctaactctttcataagccgccgccaactcctttactgcagttcaattccagaagaagacaaagcaaaaagaatgaaaaaaaagttgattagcgtataaagggagggaaagtgggaagggatagaaagaaaatacgtggaaggatgaggagaacgaaaattttaataggataggggaagagaatgtgatgtatcaaagtagagagagaaagaaaatagtgtaactgattagcgtatttagtggcttagggctaagaggtaaccaaaattaaatattttgccttaaaccttaaaaggtatctatagaatataattttttttaaatgatatttatttaaaataaataaggtgttaaactttgttataggaggtaaaaattcctaaaagaaaaccatatccatcaaagactctattctagcactcaagacatgctctagaatttacatcggccaacctcaccctctgtccatttccctgcaaaacattttaaaagagcatagaaatcgttagtattacttaaataatagtttttccttggcaaagcatgcttgaaaactttgagcatttatgtgcatgtttaagatatatattcagccattcttcaagtattatgtggtccatcttcatctgttgcataaaattttatttcttgaagctaataaagtttttgtcacatttcctagcagatgtaagtatcatctgcacacctatataatttcaagaagtacaagtttatgaggtcaaatctgaccctcaacgtctccacgccgatgggtacgcccaacgagtatacgccgactatagcaagggtatgacttaggcgtggggacaaaggcgaaactcactatcttcactaagaagacgctacctatttttgtacttttttgattttttcgaggaaggtttcctactatataaaggagacctttacattgtaacaggcatcaatgttattctcaataatacaactctcttactctctctctatctatctctacgaatactttctctcaagctcatactatctttttattttttagatctactatagcaacgccatccttttcatctctaggtcttattatatttgattacgatttaccctaatttacttttggttgtttttaagcttataaagtatattgataacttttgagccaaacaatttggcgccgtctgtggggatttcgagaattaaaaccatagtttgcacctagagaacaaccgacaaccattctccacaccacacaagagcaaaagatggttgaaaataacacaagaatgaaagcaatagtgggtatcacagccaacctcataggtcctcttaacgaggtcagtaaagaggatattttgaatgcaacccctagcatcacatcaattggagagatcccaccttccccatctgaagatctggcgatcttgtacgaaaaaggtgcttctacatctgcgactaaggaagcaccctcggtggtcaagaagctattggaggagtggctaacaagtgctctaagtggcttggtcgagaagtcactacaaagtaacatcaggtgcacaccgacaataggccttactgctgccataggtgaacctgaggttgtacgagcaaataacatgcccatcgatgtgcagacaactgatggcacactcacagtcattcttaaaaatatggaagaaatggagaatgaaaacaagtcacttcgtgaccagatgaaggaacaccgggagagggtagataagatccctagtgctcccaagttgctgccaaaacgcgacgtgggaaggttcgttgaacaaccttgcaccgaggaagttgccccttactccataccaaagacattcaagatgccaccatacctaagagtatatgacggaaccacagatcacgaggatcatctgatccactatgtcacggctgtgaagggcaacgacctatcaaatgagcaggtaccatccgtgcttctgaagaagtttggtgagatgttaacagaaggggccctgacgtggtactctcagctaccagctaagatcatttctacattcgaggaaatggcggacaagttcatcaccgcccatgccggagcaaagaaagcagaagtaagggtcaacgatatctttgctgtccggcaaacagcaagagagggactcagggacttcctagccaggtttaacagggtaaggatgagcctaccaaatgtgtcggaaggcatggcggttgccgctttccagaacgggctaaatagagatggttcgagggcgactaaaaaactactaagccgtctcatgaagtatccccctaccacatgggaagaaatccataatgcctactatactgaggtacgagcagacaaggacaatctcaacgggccgatccaacggttaacaatgatacacccagaaattagaagggatcgacacaatgagggaatgcgggaacaaatcccacgtctcaatagagaaaggcaccagccctacgtcagatcttcccatccgccaccaccaaggcacacagatgcactatagcgacatgtcgctccgctccgaaacgaaagaggtatgtctcctatattatctgcccataacttttatgtgtctccttcaaaaatagtgtacgcactggagaagctgggcaccaaggtgcaatggccgacgaagatgaaattagaccccaccacgaggaaatcaaacgtcctatgtgagttccatcaggaatgaggacacaaaaccaaagactgcataggtctacggtaagaggtagtcaggatgctgaaccaagggtacctaagggaactactcggtgacaaagggaaaaccaacttttcacgcagacgggaacaactccatggacagctgaagccgccctctccggcacgtacgataaacatgatcgtcagaggcggcgacgacttagcaatcaatcacatcaagttcaccactacgcacaaactaaagcaaaccatcgcccatgaacggtatgacgacttcgaagatagtatcaccttcgataagtccgatgtcggcggtttgtctttacctcattaagatgctttagttatcactttacatattgccgatatggatgttaaaagaatcatggtttacgacggaagtggtgcttgtaatatccatacgagggtcctcgtacaaatgggactcgaggataggataatatcgcgttgcataacactaactggttttaacaatgcaatagaacggacatccggagaagtatcactgcccgttttagcaggaggagtcacactggaaacaactttccacgtgatgaaccaggaaacggcgtacaacgccatcataggacgcccatggatacatgccatgcgagcagtcccttcaagctttaaccaagtgatcaaatttcctaccctatggggagtattcagcatcagaggcgagccgcgcaccgcacaggaatgctacaaaatagctcaagattgcacccacaccaaacaacttaagggggcgagtgcagaggcatagcaatcagctatgtcggggaccaaggtcaacccgacaatagatgccattagagaccctgacgtcgtggaggcttgcaaagctacggtcgaagatctcgaccctgtccaattggacgacaccgaccttacgaagaaatcctacatcgggaacggcctcgccaacccaagtaagtatcatgaattcttaactaaccatgaagatctatttgctttttcccattcagatgtgccaggaatcccgcgagacatcgccacccacaagttgaatgtcggtccattacacccgcctgtgcggcaaatgaggaggaaattcaacaccgctatcaatggagaggtcagtgaggaagtaacaagttactggccaatggctccatcagagaatcaaagtacccccaatgggtcaccaatgtcgtcatgctcaaaaataaaaacgggaagtgaagaatgtgcgtggacttcaccgacctgaacaaggcattcccaaaagattcattatcgctgtaccacatcgaccaactgatcgatgccaccgcaagacacaaactgctgagcttcttagatgcctactccggctacaatcagatcatgatggccgaagaggaccaggagaaaacgactttcatcacccaccaagggacatactgctacaaggtaatgcctttcgggctaaaaaatgcaggggctgcataccaaagactggtcaccaaaatgttcaaagagcagctcggtaagaccataggagtctatatcgatgatatacaggttaagtcgacaaagaaagaagaccacatcgaccatctgaagaaagcctttaagatattgaggaggtacgggatgaaactgaaccccgaaaaatatgccttcggcgtggcctcaggaaaattcttaggatttatcgtatcacaataaggaatcgaggtcaacccagaccaaatcaaggcgatagatgcaatacctgaggttttgaacagccaaaaacaggtacaaaagctgacggggcgaatagcctctctatccaggttcatctcacgatcctccgacaggtgccataaatttttcaatgtgttgaggaaagaccatgggttacagtggaacaaggagtgcgtcgaagccttgagaaaattaaaagcatacctatcttcgccaccactgctggtcaaagcaagcccaggcgaacccctactggtgtatctggccgtatccgaggttgccatcagtgcagtttttgttcgcaaaaatgaaggtacgcaatctcatatctattacattagcaaaacattaatggacgcataaacacggtatccacaccttgagaaattagctctggcattggtcgtagcttcacgaaagctccggccctattttcaatgccaccccataaaagtagtaacgaccttcccattaagaagcgtcctacacaagttcgaattatcaggcaggctcgccagatgggccattgagatcagcgagcacgacatctcatatcacccaagaaccgccatcaagtcgcaagtatttgccgactttgtagccgatttcagcgcagagatactaccagaggcggaactataggcacgtcgtgcctcctccaataccgacctgtggactctctacaccgacggtgctgccaatgcctcaggataaggactgggactcgtcctcgaggtccccacgggtgaaataatttgccaatccatacaattccccgaaatgactaacaacgaggccgagtacgaggctgttattgcaggtatgaaactagccatcaaatatggggcttgacaactcattctccattgcaactcccaactcgtggtaaaccatgtcactaggacttactaggtcaaggagcagagattgcaaatataccagtcagaaatccacccattaatgggtgagttcgatgagtgtcgcttcgaacaaattctgagggcacgaaatattgaagcagatggcttagcaaaaccgcccgcggccattaaaaacttcaacagagaaagcatggtcactctcctccattcagccattgatcacactaaggtattctctttatatttgacttgggactggcgcaaccaatttgtatcctatctacaggacgggacactcccactcgacaaaaaagaggcaaagaaactccgcttgcaagccgcctggtattgcctgataaatcattacctctacaaaaggagtttggcggacccctagccaagtgcctagggccgtaccaaacaaggccagtgctcgaagaagtacacgagggtcactgcggttcccacacatgtaatcgcgccctcgtgcgctgcatcatacgggccggctattactggcccactatgaagacaaaggcagcggagtacgttctccgatgcgaacaatgccaaaagtatgcccccatgatacaccaactaggagaacccctccactcagtcacctccccatggcctttcatcaaatggggaatggacatagtcggtcccctaccagcgggacgaggaaaggtatgatttctactagttttaactgactatttctccaagtgggtggaagcaggtgcgtacgcccaaatatgcgaacaggaagtcatcgccttcatatggaaaaatatcatatgccgcatcctcaaggaaattagctgcgacaacggacgacagttcatcggcgaataaacgacagaattcttcgaaaaatggcatatcaagcgaatactctccaggctataccaccctgctgccaacggccaagcagaatcttccaacaaaacaatactgaacatactgaaaaagaaactcgaggaggccaaagggctatggcccaagctactactagaagtattgtgggcacaccagaccatacccaaatccagcacaggagaaacaccatactcactggtctacggaacccatgctgtcatactaatagaagtcgatgaaccaagcttgagacacaccagcggaatagaaaatgacataaacagactccaagacctcgatgaggctaaggagagaagataaatggcccacataagaatggtggctcaaaaacaacaggtcgaaagatactataacaagagggccaaaataagaccactcaaagtgggagactacgtcctcaaagccaaaacactggcatccaaagacccaaacgaaggaaaactcggcaccaactgggacggaccctacaaaatcacagcagcagcaagtaaaagagcattccaattggaaacaatggaaggaaaacgctccaaaacaattggaacgtcgcccacctcaagtatttctatttctgaaaggcgtctcccgagttgtactctttttcccttacccgagttttatcccaattgggttttctcggggaggtttttaacgaggcggcggaggggacacctggagatatttgtgaaacaagtttatcatatcagcctctccatacgctctccaggccgacatgacaaaggaactagactagcatcatctccactgtgtaaacggctaaggccatctccaatgtgtaaacggctaaggccatctccaatgtataaacggctaaggccatctctaacgtgtaaacggctaaggccatctccaatgtgtaaacgactaagtccatctacaatgtataaggctaaggccatccccaaagtgtaaacggctaaggccatctccaatgtataaggctaaggccatctccaatgtgtaaacggataaggccatccaatgtataaggctaaggccatctcctgtcacgacccggatttccccaccaacgggtatcgtgatggagcctactgtcggagctaggcaagccgaaccaacatacactcagtaatttataattaacaattaataatttaaagacagaaaatataagcggaagacttaattactttcataaatgcaaaacgcggaagaaatctgatacaaatcctctacccaagaaccagtgtcacagcatacggatttctaagagtcactacatacaaacatttgaaatgaaatacacaataatgtctgtctgaactgataaacaaactgagactagtgggaaaagactggaaggtccacggacgccagtgaactaccttgcagtctctggactgaaggctggctccccgtctactgctgatgcgctccaaaagctgctcccggatctgtgcacaaaagggcacagaagtgtagtatcagcacaatccgaccccatgtgctggtaagtgcctggcctaaccccggctcacgaggtagtgacgaggctagacaggacctacagcgttaacctgtgcaagatatatatgcatacgacaacaagaagaaatactgtaaagtaaacagatacgggaggggaacatgctgtaagggggaacagttctaaagcataaagtacaataagctaaagcagttaatctacgactactcaaagtaaaacagtaggtacgaagtggacggcgcgccacacgatcccatattcaatattcaaaagtggacggcgcgccacacgattccatttcatatattcaggtgggcggtgtgccacacgatcccatattcaataatctcaagtggacggcgtgccacacgatcccaacatcaatagaagttcagctctattcaattacacataagtcctatctcaaggaacacaacaatttacataaactcatctaacccggcaagggtgcagctataaccaaacaatcccggcaagggacacaagaatcatatagaattcaacatttcccagcaaggcatttcacttgaactatccaattaagtcatttaattcatttgattccaataggtatttataagaatcaattcaatagctagaattcatgacatagctttcaacaatttcaattaaagacccacggtcatgctttgactcgggtgcataggtaaccgtcaccaaacctatacaccgacccatgtaacacatagcaaataatatcctagtcctaatccctcgaactagagttagaacaaacacttacctcaatgccgaactagcaattcaaagctctacaactgccttccctttagaatccaactcccaaaccacgatatctaagcataattagattcaaaatcatcaataacaactcaataattcaaccccaaagcctagaaatgaaatcccaaactttcctccaaaaattccaaaatccgacactgggcccacgtggtccaaactcgaggttcggaccaaaatccaatcctccaaatccccacgagttcaaatatataattagtttttaaattcgacctcaaattgaggttgaaatccccaaaatcacaaaagccctagtttctacccatttcccccattttctactttgaattcaagctttagggctaggaaattaatgattagtggaagaacttaagaggaaaaggagttaaaattacttacccaagagtttatggagaaagaatggcttgaaattcggctatggtgagttttggagaagaactcgtgtaagaaaagtgaggaaaaacgaagtgaaacagtgctggaattttaagaaatcactgaaggaattaaagctacgcgatcgcgatcaagggttgcgatcgcgaagagagctgaccaaaacaagcatcgcgttcgcgatgtggctatgcgaacgcgcaaaacaaaaaggctgggggtctgaggtcctctatgcgaacgcgaggtagtcacgcgatcgcgaagggtaattggatggggggtctaggggagtctatgcgaatgcgatgtgggatcgcgaacgcggagtgaggaggcagcaacgcatcgcgaacgcgggtgctgaatgtgaacgcgtagaagaaattttcccttggctcagctgaacctacgcgaacgcgacgggcttatgcgttcgcgaagagtaatttggtctgcaacagaagttgaaaatctgatgtgtttctaaggcaaaaaccactccaaaccacccccgaaaacactcccgagccctcggggctcccaaccaaacactcaaactaactcattaagcttctacaaacttgctcgagcgatcaaatcgctaaaataacatcaaaatcatagaattaagccataaaatccataatttccaaactttaacttcaaactttccatttagcttttaaggtccgaaatatgtcaaacggcgtccgatttcgaccaaattttacaggaagcgcttaaacgccatataagacctgtaccgggcgtcggaaccaaaatacgatcccgatatgacagtttaaaatcgattattcattttcaaagtcttaagatattttcagaaactattttcacagaaaattccgtatcttgggcctgggacctcagaattcgattccgggcatatgcacgagtcccaaattttactacggatatttagaaattgataagtcatgggttcgggcccgtttgcccaaaatattgaccggagtcaactctattaatattatacttgaaatttatcatttttaacacagaattcactttacatcacataaaatctttccggcttcacgcccggactgcgcacgcatatcaaggcaacccctcaagaggtttttgaggactcagaagcacagaacaaaggagaattacggtgatgaccccattgggtcgtcacaatctccacctctaaaataaccgttcgtcctcgaacgaacaaaagaaagaagtacctgagtcgggaaacagatggggataacggctacgcatatcggactcggactcccaggtcgaagcctcaggaggctgacctctccactgaacacgcactgaaggaaaactcttcgacctcaactgccgaacctgcaggtctagaatagctaccggctcctcctcataagacaaatccttgtccaattggacagtgctgaaatccaatacatgcgagggatcgccgtgatacttccggagcatggatacatggaaaactggatgaacagctgataaactaggtggcaaagcaagtctataggccacctctcccactcgctccagaatctcaaatggaccaatgaatctagggctaagcttgcccttctttccgaatctcatcacgcccttcataggcgacacacggagcaatactcgctctcctatcatgaaggcaacatctctgaccttgcggtctgcataactcttctgcctagactgagctgtgcgaagcctgtcctgaataatcttgaccttatccaaggcctcctgaaccatgtcaacacccaataatcgagtctctcccggctcaaaccaacccactggggatctgcaccgcctaccatacaacgcctcataaggagccatctgaatgctggactgataactgttgttgtaggcaaactctgctaaaggcaaaaactggtcccacgagcctccgaagtcaatgacacaggctcgaagcatatcctcaagaatctgaatcgtccgctcggactggctcctctctcagtgctggtgtgctccaaatgctgctcccggatctgtgcacaaaagggcacagaagtgtagtatcagcacaatccgaccccatgtgctggtaagtgcctggcctaaccccagtccacagaaattaatccgacgcgggtccgagcccgtttacccaaaatgttgaccggagtcaaccatatcaaggttatactcaaaattcatcattttaagctaagaattcatttttcaatatataaagtctttccggcttcgcgcccggactgcgcacgcatatcgaggcaacctttcaagaggttttcaaggcctctgaagcatggaataaggagcatttaaggtgatgaccccattgggtcgtcacaatctccacctctaaaacaaccgttcgtcctcgaacggacaaaagaaagaaatacctgagtcgggaaacagatggggataacggctacgcatatcggactcggactcccaggtcgaagcctcaggaggctgacctctccactgaacacgcactgaaggaaaactcttcgacctcaactgtcgaacctgccggtctagaatagccaccgactcctcctcataagacagatccttgtccaattggatagtgctgaaatctaatacatgcgatggatcgccgtgatactttcggagcatggatacatgaaacactggatgcacagctgataaactaggtggcaaagcaagtttataggccacctctcccactcgctctagaatctcaaacggaccaatgaacctagggctgagcttgcccttcttcccaaacctcatcacgcccttcataggcgacacacggagcaatactctctctccaaccatgaaagcaacatctctgaccttgcggtctgcataactcttctgcctagactgagctgtacgaagtctatcctgaatgatcttgaccttatccaaggcctcctgaaccatatctatacccaataaccgagcctctcccggctcgaaccatccgactggggacctacaccgcctaccatacaacgcctcataaggagccatctgaatgctggactgatagctgttgttgtaggcgaactctgctaatgacaaaaactggtcccacgagcctccaaagtcaatgacacaggctcgaagcatatcctcaagaatttgaatcgtcctctcggactgaccgtccgtctgtggatgaaatgctgtgctcatctgaacccgagtgcccaactctccatgcaaggctgtccagaaatgcgaagtaaactgcggacctcgatccgaaatgatagatatgggcactccatgaagacgaactatctccctgatgtaaatctcagctaatctctgggacgaataggtggtagcaaccgagatgaagtgtgctgacttagtcagcctatccacaataacccaaactgaatcacactgcctccgagtcatcgggaggccagtaacaaaatccatagtaatcctctcccacttccactcgggaagctcaatcctctgaaatagaccaccaggtctctgatgctcatacttcacctgctgacagttcaaacaccgagcgacataagcaactatatccttcttcatcctacgccaccaataatgctgtctcaaatcttgatacatcttcgcggcgcctgggtgaatagaataccgagaactgtgggcctccgctaagatcaaatcacgaataccgtcaacattgggcacgcaaactcgcccctgcaatctcaacacaccatcatcacccaaagtcacttttttggcacctcctcgctgaaccgtgtctctcaggacacataaatggggatcatgaaactgaagcccgcgaatacgctcaaatagagaagagcgggcaaccgtacaagccaaaaccctgctgggctccgaaacatccaacctaacaaaacgattggccaaggcctgaacatccaaggcaagcgatctcttaccaactgggatgaaagcaagactatactagccgacttcctactcaatgcatcggccaccacattggccttccccggttgatatagaatagtaacatcataatccttcaacaactctaaccacctcctctgcctcatattcaactccttctgcttgaacagatactgaagactcttgtgatcagtgtaaacctcacacgtcacaccatataagtaatgcctccaaatctttaaggcatgaacaatcgctgctaactcaagatcatgaactggataattcttctcgtggatcttcaactgcctcgaagcataggctataaccttaccgttctgcattaacactgcaccaagcccaatacgagaagcatcacaatagaccgtgtacggtcctgaacctataggcaatacaaataccggtaccgtggtcaatgctatcttgagcttctgaaagctcgcctcacactcgtccgaccacctaaatagggcacccttctgggtcaatctggtcataggggatgcaatggataaaaacccctctacgaaccgtctgtaataaccagctactctgtagctgaagctggtcgaggccagttcttgactgcctctatcttcttcgggtctacctgaataccctctgctgaaacaacatgacccaagaatgctactgaactcaaccaaaactcgcacttagaaaacttggcatacaactgactatccttcagagtctgaagaaccactctgaggtgctgctcgtgctcctcctgactgcgggagtatataagaatatcatcaatgaagactatcacaaataagtccaagaaaggcctgaatactctgttcaccatgaacacagctggggcattagtcagcccaaatgacataaccaggaactcgtagtggccatagcgagtacgaaatgctgtcttagggacatcagacgccctaatcctcaactgatgataaccggatctcaaatctatcttggagaataccttcgaaccctgaagctgatcaaataaatcatcaatcctcggcagtggatacttgttcttaatcgttaccttgttcagctaccggtaatcaatacacatccgcatagaaccgtctttcttcttcacaaatagaactggagcaccccaaggcgacacactgggtctaatgaaacccttctcaagcaaatcctgaagctggtcttttaattctttcaactctggcggcaccatgcgataaggagggatagaaatgggctgagtgcctggcgccaaatcaatacaaaaatcaatgtccctgtcgggcggcatgcccggcaaatcagaaggaaagacctcagggaactctcggacaataggaacggaatcaatagacgggacctcaacgctggagtcacgaacataagccagataagctagacaccccttctcgaccatgcgtcgagctttcgcataagaaatgacactgcgagtggtatgaccgggggtccctctccactctaatcggggcatatccggcaacgccaaggtcacggtcttggcatgacaatccaagatcgcatgataaggagataaccaattcatcccaagaataacgttgaaatccaccatatccagcaataataagtcaacacgggtctcaagacccctgaataccacaacacacgagcgatgaacccggtccactactagagaatctcccactggagtggacacatgaacaggaatacccaaggcctcactaggcataaccacacaaggtgcaaaatatgacgacacataggaatacgtggatccaggatcaaacaatactgacgcatctctatcatagaccagaatagtacctgtaatcacgacatcagatgactcggcctcaggtctggccggcaaagcatagcaacggggctgggccccacctccctgtatgacatctctaggctgatctgcaactgcctgacctctacctcgagctggctgagctccacctctatgacctctgcctccacctctatgacctctacccccgcctctagctggctgggcagtctgtggggcatgtggtgcctgaatcatgggacggggtccctgctgctgagaactgctggaagctctaggcaatacttggcgatgtgcctcgtatcgccgcaagtgtaacaagctctgggctgctgagcatacctcaatggtgctgcactgataggtgcggaaggagaactgtacagctgctgatcggaaaactgtgcctgtgaaccacgaccacctggggcaccctgagaagtctggagagctgactgaaaaggtctcggaggctggcccctagcatgtgaacccctacctccagacgaggtaccactgaactgaccagaacgacggggcctcttatctgacccagtaccgcctcataaagacaatgccatctcaatccggcgggcaccatccgccgcctcctgaaatgtaagagcaccaccggcactcatagccatctgcactcggatatccggggacaacccctctacaaacctcctgaccctctcgccctctgtaggaagtagcaataaagcatgacgggcaaggtccacaaaccgcgtctcatactgcttgacagtcatatatccctgctggagacgctcaaactggcggcgaagagcatctctctgagtgacggggagaaacttccccagaaacaactctgaaaactgatcataagtgagggctggcgaccctgctggcctagtcaaacagtaatccctccaccaagtcttggcggatccgatcagacgaaaagtggcaaaatcaactctattagtctccacaatacccatagtactcaaggtctcatgacaagtatatagatagttctgagcatcctcagaaggtgcaccactgaaagtatgagggaaaagcctggagaaacgatcaagcctccataaagaatctgcgtacatcgccgctccatcactagtccggcctgaaataactggcggggctgctaccacaggctgagctggcacaaccggaggatctggcataaccgactgaatcggtgcaactggagggactggcaccgcaggctgaactggggcaacctgctgcactggcggtgcctctggtgtctgaaatccctgcaccgctggcttgggtgtatgcataacgggggtctgagtacctcccccagtctgagaagtggcagctgcggcggtggctgagaccatctgtgccagactagagcaagctgacatgatctgagctagggcctcctgaagacccgggacgaccataggtatagctggggctggagtctcctcaatatgaacctggggatccacctctggtgctactacttggggctgagctctgcccctaccacggcctctagcgcggcctcgccctctgcccctagctgaagctgctgctggggcctcgggctgcaagaggaagctcgagctctcgccatctgtgaagaaacagagtagagagacaatcaatattgagaaacagaatcgcacgacaagaatgaataaagtgagatttttcctaactctgtagcttctggggaacaagtacagacgtctccgtaccgttccctcagactctaccgagtttgtccgtgagctgagagactcaagtaacctagtgctctgataccaacttgtcacgacctggatttccccaccaacgggtatcgtgatggcgcctactgtcggagctaggcaagccgaaccaacatacactcagcaatttataattaacaattaataatttaaagacagaaaatataagcggaagacataattactttcataaatgcaaaacacggaagaaatctgatacaaatcctctacccaagaaccagtgtcacagcatacggacttctaagagtcactacatacaaacctttgaaatgaaatacacaataatgtctgtctgaactgataaacaaactgagactagtgggaaaagactggaaggtccacagatgccagtgaactacctcgcagtctctggactgaaggctggctccccgtctactgctgatgcgctccaaaagctgctcccgaatctgtgcacaaaagggcacagaagtgtagtatcagcacaatccgaccccatgtgctggtaagtgcctggcctaaccccggctcacgaggtagtgacgaggctagacaggacctacaacgttaacctgtgcaagatatataagcatacgacaacaagaagaaatacagtaaagtaaacagatacaggaggggaacatgctgtaagggggaacagttctaaagcataaagtacaataagctaaagcagttaatctacgactactcaaagtaaaacagtaagtatgaagtggacggcgcgccacacgatcccatattcaatattcaaaagtggacggcgtgccacacgatcccatttcatatattcaggtgggcggcgtgccacacgatcccatattcaataatctcaagtggacggcgtgccacacgatcccaacatcaatagaagttcagctctattcaattacacataagtcctatctcaaggaacacaacaatttgcataaactcatctaacccggcaagggtgcaactataaccaaacaatcccggcaagggacacaagaatcatatagaattcaacatttcccggcaaggcatttcacttgaactatccaattaagtcatttaattcatttgattccaacaggtatttataaggatcaattcaatagctagaattcatgacatagctttcaacaatttcaattaaagacccacggtcatgctttgactcgggtgcataggtaaccgtcaccaaacctatacactgacccatgtaacacatagcaaataatatcctagtcctaatccctcgaactagagttagaacaaatacttacctcaatgccgaactagcaattcaaagctctacaaccgccttccctgtagaatccaactcccaaaccacgatatctaagcataattagattcaaaatcatcaataacaactcaataattcaaccccaaagcctagaaatgaaatcccaaactttcctccaaaaattccaaaatccgacaccgggcccatgtggtccaaactcgaggttctgaccaaaatccaatcctccaaatccccacgagttcaagtatataattagtttttaaattcgacctcaaattgaggttgaaatccccaaaatcacaaaagccctagtttctacccatttcccccattttctactttgaattcaagctttagggctagaaaattaatggttagtggaagaaattaagagggaaaggagttaagattacttacccaagagtttatggagaaagaatggcttgaaattcggctatggtgagttttggagaagaactcgtgtaagaaaagtgaggaaaaacgaagtgaaacagtgctggaattttaagaaatcactgaaggaattaaagctacgcgatcgcgatcaagggctgcgatcgcgaagagagctgaccaaaacaagcatcgcgttcgcgatgtggctacgcgaacacgtagaacaaaaaggctgggggtctgaggtcctctatgcgaacgcgaggtagtcacgcgatcgcgaagggtaattggatggggggtctaggggagtctatgcgaacgcggtgtgggatcgcgaacgcggagtgaggaggcagcaaagcatcgcgaacgcgggggctgaatgcgaacgcatagaagaaattttcccttggctcagctgaacctacgcgaacgcgacgggcttatgcgttcgcgaggagtaatttggtctgcaacagaagttgaaaatctgatgtgtttctaaggcaaaaaccactccgaaccacccccgaaaacactctcgagccctcggggctcccaaccaaacactcaaactaactcattaaccttctacaaacttgctcgagcgatcaaatcgctaaaataacatcaaaatcatagaattaagccataaaatccataatttccaaactttaaccttaaactttccatttagcttttcgggtccgaaatacgtcaaacgacgtccgatttcgaccaaattttacaggaagtgcttaaacgctatataagacctgtaccgggcatcggaaccaaaatacgagcccgatacgacagtttaaaatcaattattcattttcaaagtcttaagatattttcagaaactattttcacagaagattccatatcttgggcctgggacctcggaattcgattccgggcatatgcacgagtcccaaattttactacggatatttagaaattgataagtcacgggtccgggcccgtctgcctaaaatgttgaccggagtcaactctattaatattatacttgaaatttatcatttttaacacagaattcactttacatcacataaaatctttccggcttcgcgcccggactgcgcacgcatatcgaggcaataatgggtagtgacgaggaaggtcaaggcccaactgagattaatataataagaggcaataatatgaataaacagaagagtacagctatatcgagagctaacaagataataagtaacggaaacaggttataaactatagtctaagaatgaagaacaactaacaataagctaacagtcatcggggatctcctggtatcccgaggatctcccggtatcctcatcatatacacaagggatctccaagtatcccgaggatctcttagtatcctccattaatcaatagggatctcccagtatcccgaggatctccgagtaccctccgtttatagttagttctgtgccggggatctcccggtatcccgcacttccaatctcaatagaatacgtacaggggaactcccgggatgccgaccagtagtcccaagttgtaaacacatcaccgctatttaatatcgtacagacactgagtaaaggcaataggtaaaaatctagaactagcatgcttcacagagaacaggtattttaactaagtcaaataaggtagttaaatcatctaacatgtttttcctacactatcacaggtaaaacttgtatttagacagtctaataagcgaagaaatatagtataagttatccaagtaaggtgaatttctaacaattagcacgagtacacgcccgtcacctcacacacaaggcatttaaaatagtagtcaagatatcctaagggaagaagtcccccacacaaggttagacacgccacttacctcgaaccggtacaaaaatctctacaaagcgatgcccttgccatgagtatccaactccaaatgacccgagtctattcaaaccaattacataacgtaaataatatcgcaagtaactaattacactattaaaattaaagctaaggcgcgaaaataggaaaaatgaccaaaacacccctcaggccaacgtctcagaatcggataatttttacattttcagaaacctcgtactctcacgagtctaaccatataaaattctcccaaatcggagatcaaatgccccttcaaataatcaaagttaggtctaagaactttaccccaattttcatccattttgatccttaattcgaatttaaaagatgaattaactactaaatgatagattaaatctaggaagggtcatagaaacgttacccagtaatctcctctttgaatccctctcaaaattgccttggtccgagctcaaacttgatttttcaacttatgaaatttaagcctcggataaaccccttttctctactgtgatttccgcttctgccgctatatgaccgcacctgcggtcatcgcttatgcggccaagcaaccgcttatgcggtaagactaacaatgccagggaccgcttctgcggctcaggaccgcttatgcggaccctcatccgcttctgcggtccaagaccatacccctcagaaccgcatccgcgactccaacgccgcatctgcggaaactgcttatgcggctccccttccgcagatgcggaaacaatagaagcagcagccacaacccatgcaaaactctccaatttctccggttaaccactcgaattcaccccgaggcctctgggaccccaaccaaaagcaccaatacttcctaacacctcattcgaacttgctcgaatcctcaaaactccaccattaacatcaaaatcctcatttttcatcaaattaaagcctaagttccatcaaaacttccaaaactcgctttcgatcaaaaacctaaccaaaacacgttcgattgacctgaaactttacacgcacgtcccaaatgacatgacggtgctacagcaacttccggaatcccattccgaccctcggatcaaaaattcactatcggaccggaaacttcaaaattctaactttcggcatttctagcctaattgagctacggacatccaaaacacattttggacactctcccaatctcgaaattacctaacggagctaacggaaccatcggatgtccattccgaggtcgtcttgacactgttccaactacgggccattttccacacttaagctctcaaatagggactaattgtcccaaaacactccggattcaaataccgaatatcccggcaaaccaaaatatcataactaaacttaggggaagcagttaatgggggaacggggcgcgaattctaaaaatgaacggccaggtcgttacatttagatctcaaaaacattcgtagtttgatttaggcgcgtttaaataaatcatcatggctatgtgtacggtttccgtggcatagtcatgatacataatccccaaatttgggtgcacatttcatgtcacccggccacaacttcgaacaataataaaatacacatgttataaattgtaggtacaattcccgtgacacgattcacaatgtgtacaaaaataaaaaagtgtacgacaattgtaacttgttccagaaataattctataaataattaaaagcggttaaaaggtaaaaatgcacaatagagtttaaacatgtaataaataagataaatagaccaattattaatagtgcgatcgtgctaaaaccacggaactcgggagtgcctcacaccttctcttgggttaacagaatttcttacctggtcttctgtgttcgcagaccataaaatagagtaaatttcctcgatttgggatttaaaatacactagtgacttgggacaccataaattattttaagtgtcgactcttaaattaaataaataattccatttcggttaatgtcactttaattagaaaaactccctatcccctttgggaaaaaagagatgtgacagactgtgcagggcaattacttcagagcccaaatgaagtggagctagagatcctgaatttttataagttgttacttggtacatcagtagcacagttgccagcagtcaatacagaaatcatgcaacaaggatatatgctgagtaggcaacaacaattgcagctgataagaactgtcataagagatgaagtcaagcaatcaatacatgacattaatgacaacaaagcaccaggatgtgatgggtataactctttcttctttaagaaaatatgtcatatattgggtgaggagattactggagcactgatggagttctttgaaagtgctgaaatgtgtaaacctattaactgtaccaccattattttgatccctaaagtaaagaacccagatagcataaagaaatttagacctatgttttgctgtatagtgctatataagataatatcaaagattctaacaacaagactacaggaagtcatgccagaccttattgaaaattgacaaatagcctttgttccaggaaggttgattacacacaatatcattgtgagtcatgaattagttaaaggctataggaggaagattatctcagcaaggtgcatgctaacgattgatatgcagaaagcctatgatgatatgtaatgggtatatcttgaacaggtgatgagaatgctggggattccagaaaagtttaatagtttgtattagcacaatctcttattctatcataattaatggtaagctaggcctttgaagcaaggaaaggacttagacagggggatcccctatcaccattgctatttgtgatggccatggagtacctatgcagactaatgaagcaattggggaacaacaaggaatttagatttcaccctagatgtgctaaagtcaatctagtgcaattgggatttgctgatgatttattgcttttctataagggagacatacagtttgtcaagactctgcacaaacaatttcagactttctctgcagcttcaggtctaattgcaaaattcaaacaaacgttgtatctattttggaggagtggacaataggacacaacaacatattatggaactgttaggatacactaaaggagatctaccttttagatacgttggtgttcctttgagtataaagaggctgacagcaatgcaatgtgaatccctaattgatagaatgctaagcagaattcagtgctggacaataaagttttttttatcatatgcaggtagagcaatgccaatcaagagagtgttagtggcaatttagaatttctgggctcaaatctttatactaccaaaaaagattatacaatttatagaaacaatatgcaggaggtttctattgtcggacagtgctgaaccaaatgataaggcattgattgcttgggataaattatgtgctccaaaggcagcaggagggctaaacttcatcaatgtggaaccgtggaataaagcagtcatatgcaagcttctttggaatatccggacaaagagagaaaaattgtgggtttaatggattcatgcctactatataaaagggaacattatatgaaacactgatccaaagagtgcattgcgggttatccaaaagatcttcaaggccaaaagatagtttgaagaggctgtctattcagtagaagaagtgaatcaaatggaaaagttctctataaagcacttatacaaagcattgcaagagaactttcaaaaggtgtcatggtggaagatagtctgcaacgacaatgggcttccaaaagagatattcatcttaaggttggcactacaagataggttagccaccaaagaaagactagcacgatggggattagtagaagacacagtatgttcacttgttagagaaagaatgggacaatacaacacttgttttttgaatgtgaattaccagatactgtatggcagaagcttatacattggcaaggaatcacgagaaggaagaaataatgacaggaagaaatacagtggacagagaaggtggtcaaagggaagagtgcaggagcagcaatatacataatggtgttagctgtagcagtctatcatatatgacaagtaagaaataatacaattttcctgaagaagaagagtaatgcaaatgctatagttagattgatcatccaagaggtacacattggagctcagcaggttgcaaaaccggagagttatttgagtaatatgaattggtatccagactgagcataagtgtagaggcaataggagaataagaagtaagttagaaaatttccttttcatgaaaagcaagggtacgacttaggcgtgggggcaaaggcgacgtcgcttaaaactcaacgtcttcactaagaagacgctacctacttttgtacttttttgattgtttcgaggaaggtctcctactatataaaggagaccttcacattgtaacacacacaatgttattctcaataatacaactctcttactctctctctatctatctctacgaatactttctctcaagctcatactatctttttattttttagatctactatagcaacgtcatcttttttatctctaggtcttattatatttgattacgatttaccctcatttacttttgattattttaggcatataaaatatattgataacttttgagccaaacaacaagtattccaatgttgctaattaggcattatttccattaccaatgatacctgtaacttttgtttatcctctattttctccaataaacatcttagaagtagcaaatgaattacagaccatactataacctaagatatccacacacaatccaaagtagaatgctagaaacacatacaaaatctcttattataacaatcaaagaaaaaatgaattacctataagagctatttgatcactacactttatataatgcaattaccatatttttaaacacatacccatactaagttctcggtgctaatattatttatacaatgaatcaaggacaacataaatcataccggttaaaactaacacaaaacttcaattcaatggcataagcatcaagactgccgttgtaacgatccggcgggttgtattatgagttaccgctccatttctcttatttatgtttctttatgtgtttttcagctgtatttcatcatatcgtgttggttgatttaggtttggggtggttttgtagaggaatgagacacttagtcttttttgagtaagcttaagttggaaaagtcaattggatgttgactaatgggtagaaggtctcgggtgtgaattttgatggttcagttagcttcttcaggtgatttggaacttagcaacgttatcaaaatgtattttgaaggtccgtggcagaattaggcttgaattggcaaaattgaaattttggcatttttcgattggcagtgaaaatattgatatcaggattggattaaaatttcgaaaattgaagtaggttcgttgagtcatttgtgacgtgtgtgtaaatttcagataattcagatgaggtttgataggtttttgcatcatttacgaaattcgaaagttagaaaatccttaggcttgaatcctaaggtgatttaatgttttgatgttgttttgagtgtctgaaggttggaacaagtttgaatgatgttatggtatgtgttggcatgtttggttgaggtctcgagatcctcgagtgagtttcgggtggttaacggatcaatttttggcttttgaagttggcaaatttttggtattttgttgctgagaattcattcttcgcgttcgcgaagggttaatgagaggggaaaccgagttcttcgtgttcgcggaggtgtatgagtttaaggctacgtattcgctagggcgttcagctctagagcttgaagtttcccagttacaacaaaaaaatttcagctctagggctgaagtttcctagttacaacacaaacttcagctctatagctgaacttcaggccgactactagaatgctgaagttttgcgtgattgtctttgctacttcagccccgtgtgctgaaattatgtgaaaagcggctacacttgcactttttttgcaaaacgagcacaagttaaaatgtgacacaaaaagcgggtatagatgcaaatgatccatgttttgtatccacgtcaattcattaagcccaaaacaaaattgatgctagtcacacctattaaaagtgataccgttgataagaatttatactcatttcgtgacgcgttacttatagtaatagaatcaaattacttcacaattaaatgtttcaatgatatttcattatacacaatgcaacctaaataaatgccataactttagatctcataaacattcgtagtttgctttaggcgcgtttaaataaatcatcatggctatggttttcgtggcataatcatgatacataattcccaaatttgggtccacatttcatgtgacccgaccgcaactttgaataataataaatacacatgttataaattgtaggtacggttcccgtgacacgattcgcaacatgtacaaaaacaaacaagtgtacaacaatcgtaacttattccagaaataattccataaataactaaaagtggttaaaaggtaaaaatgcacaataaggtttaaacatgtaataaatcaaataattaggccaattattaatacctgagcgatcgtgctaaaaccacggaactcgggagtgcctcacatcttctcccaggttaacataatttcttacctggtcttctatgttcccagaccataaaatagagtcaatttcctctttttgggatttaaaatacaccggtgacttaggacaccataaattatttcaagtggcgactttaaaattaaataaataattccatttcgattaatgtcactttaattggaaaaactccctataccctttgggaaaaaggacgtatgacagactgtgcagggaaattacttcagagtccaaatgaagtggaactagagatcctgaatttttataagttgttacttggtacatcagcagcacagttgccagcagtcaatatagaaatcatgcagcaaagatatatgctgagtaggcaatgacaattgcagctgataagaattttcataagcgatgaagtcaagcaatcaatacaggacattcataaagcaccatgatgagatgggtataactctaccttctttaagaaaatatgccatatactgggtgaggaggttactggagcagtgatggaattctttgaaagtgctgaaacatgtaaacctattaactgtaccaccattattttgatacctaaagtaaagaacccaaataacataaaggaatttagacttatatcttgttgtatagtgctatatataataatatcaaagattctaacaacaagattgcaggaagtcatgccagaccttattgacaattgtcaaataacctttgctccggttgatcacacgcaatatcattgtgagtcatgaattggttaaaggatatgggaggaagattatctcaccaaggtgcatgctaacgattaatatgcagaaagcctatgattatgtggaatgggtatatcttgaacaggtgatgagagtgcttggtattcaagaaaagtttgtaaagtgggtaatgttatgtattagcacaatctcttattttatcataattaatggtaagccaaccaagccttttgaagcaaggaaaggacttagacatggggatcccctatcaccattgctatttgtgatggccatgtagtacctgtgcaggctaataaagcaactgaggaacaacaaggaattcaaatttcacccaagatgtgctaaagtcaatctagtacaattggaatttgttgatgacttattgcttttctataagggagacatacagtctgtcaagactctgcacaagcaattttagactttctctgtagcttcaggtcaaattgcaaaatccaaacaaaagctgtatctattttggaggagtggacaataggacacaacaacatattatggaattgttaggaaacactaaatgatatctaccttttagataccttggtgttcctttgagtacaaagaggctgatagcaatgcaatgtgaacccctaattgatagaatgctaagcagaattcagtgttgcacaataaagttttttttatcatatgcaggtagagcaatgctgatcgagagtgtgttagtggcaatttagaatttctgggtttataccaccaaaaaggattatacagtttatagaaataatatgcaggagatttctattgtcgggcagtgatgaaccagacaagagggattgctctgatggtaagcaacccccacttccaaccgagaggttgtgagttcgagtctccccaagagcaaggtgggaagttcttggagggaaggatgtcagaggtctatttggaaacaacctctctaccgcatgataggagtaaggtctgcgtacacactaccctcctcaaaccccattaatgggattatactgggttgttgttgttgttgttgttgggcagtgctgaaccaaataagaaggcattgattacttgggataaattatgtgctccaaaggcaacaagagggttaaacttcatcaatgtggaactgtggaataaagcagccatatgcgagcttctttggaatatctgcacgaaagaaagaaaaattgtgggttcaatggatacatgcctactatgtaaaagggaacactatatggaacactaatccaaagagtgcatcgtgggttatccaaaagatctttaaggccaaaagacagtttgaagaggctggctattcagtagaagaagtgaatcaaatggaaaagttctctataaagcacatatacaaagcattgcaagggggctttcaaaaggtgtcatggaggaagatagtctgcaacaacaatgggcttccaaaatggatattcatcttaaggttggcactacaagataggtaagccaccaaagaaagactagcaagatggggattagtagaagacacagtatgttcacttgttagagaaagaatgggacaatacaatacttattttataaatgtgaattatgatatgctgtatgacagaagcttatacattggcaaggaatcacgagaaggaagaaagaatggcaagaagaaatacagtggacaacgaaagtggccaaagggaagagtgcaggagcagcaatatacataatggtatttgctgcaacagtctatcacatatgacaagtaagaaataattccatttttcgagaagaagaagaataatccaaatgctatagttagattaatcatccaagaggtacacattggagctcagcaggttgcaaaattggatagctatttgagtaatatgaattggtagccagactgagcttaagtgtagaggcaataggagaataagaagtaagttagaaaatttccttttcatatccagcaggaactctgttaggcggattggattttgtaaagatgtaaatatttacttggtaaataaagtctttaattacccaaaaaaaatatatttattatattataaagaaagatacataacaaaaaaattattcaatgactatataagtcccttttatttgatagaaattttgttcacactaaaattcatataaattgacaacaacataataaaatttaaaataaaaaatatttcaagattaataaaatatatatcttttcttatattacaaaaaagacgagcaaataaacattaaataaagtaatatactaatatttaccgcgcatcgcgggtacaactactggtgttccttaacgtggaccgtaggatctttattgaactacttgatctgaactgctacagtctcacccttccccctacggatactttatcacagaaaaaaaaggaaaagaaaatcatctcttccttttgttcttattttaaccctagaaagaaacccatttgtcttcacttcaactgttgctgggtttggatcgtttcctccaggacacgggtaaactaattcaatatagtatttatttttgcaatttctataatatttgaaaattttcagtcattgaaccctaaaacgaacataaaattggggcctgcaatttctatttgttcctcctcctttgtgtttgtcgaagcaaattttcagcctttaaactcttaaccaacataaattctgtaaaaataattataaaaatccaatctttggttccaaagtttggaacttttttctattttgaacttgggatgatcctgctctgctataatatatttttggattagtactttttgtaaaactattatttcattccttatgacattgaaggggagccttggagcaaccactcgtgcatatggtccttcccccgaccctgattcgtgcaccgggctgcattgcctggccgttatgacagtttttgactaatatgtaatgtttctgcaaaatttatttactagtatttaattaaggtagtggcatgtagttgtttggagccgtttcccccttaattgctcatatgattgactgattgcttctgaagttaattttggatcataaatctctaactaaattgtgaatatcttatcagctaatattatcatcattcgagtttgataattgtcttcagctaatatcatcatgacgacaagtagtttgagttctttgaattagatgggtgaaatcaataaagttttgattttgacaggagaatttgattgattcttaaatcttgataaatataaaaatccattctttggttccaaagtttggaacttttttctattttggtaaatattttgaacttgggatgatcctgctctgctctaatatatttttggattactactttttttaaaactattatttcattcgttgtgacattgaaggggtgccttggagcaacgttatagtttgtttccgtgtgacctataggttatgggttgagccgtggaatcaaccactcgtgcttgcataggggtagactacttacatcatatggtccttccccggaccctacataaacatgtgatgcttcgtgcaccgggctgcattgcctggccgttatgacatagacttacaatttttgactaatctgtaatgtttctgcaaaatttagttactagtgtttaattaaggtagtggcatgtagttgtttggtgccgtttcccccttaatttgctcatatgattgattgattgcttctgaagttgattttggatcataaatctctaactgaattgtgaatatattatcagttaatattatcatcattcgagtttgataagtattttgggttcttggaattagatgggatgatttccaagaaattgttaaagttttgattttgacgggtgaatttgattgattcttaaatcttgatgctgccatgagtgttttatttattctttgcttagttgctttttttttgtgggatttgtttgttgaagcacaaaatgttgctacatttattcttctctatatttttgtttgtttttgtttcgttgcagctgtgaactttacgtgaattagtgaaatcctgttaacaggttctccagcgtatccttctccttaattttatccctttctagtgaaccttatatctctttaatataagattggcaaaacttgtatcaatataagtaaaaaatttatgattaaatgtatgtgtctatctatatgcagctagatgggtgaagttcttcctctgtgtgcctctcctcgtggcttattcctctacacttggacggtttcctctcagaagtgctggcagagcttgaagactgcgatttcatttgttaagaagtttaggtgggcatggccgtcttcaatgggtggtccaccaaatggtggtagtaagtctctttcctaaagattgatattataagttttggcctgcaataattttttgataagaatgatagcccaaaaaagcagtaggatttttaaatattatccaagtaggctggcatgtaaagcttgtttttttccatttaccataagcttcttggaggccaaggccaccaacattcttatgcttcgtgacaatgtcgaaatttaagagtttctgtaagtatagcttttctggtcgaacccgtccaaaccaactaagaagaaccgaactcttttttgttatgaatcagccccagcccactgtctcacaagtagctattaggctgactgctgagaagagcttttgggctgaaaacaagtaatagggtcaggttaatttgggatccaggttgagtgtatgatgcaaggatggttctgttaaaagggggactgggcggttattttgagatgaggcatattgttgagaaaggtgtccgtttctcctcgtctcccgttatttaagtctaatcttcttatccacttcttctatctatccgtagttactttacttccagcaatttctattgtaattctgctactaagttgttgcactttgatatttgagttgtaaacttgtaatcacatttcagtcttattaatagagtggagtcagttacagatctattcctgtctcacttatgaagagttacttcaacatttccttggtcatttctggccactacctttctgcagatttgacattttacagttgtgaagatatttactaaacttcttggttaaccatactcacgaaagaaaagatgagtagctttatatagtgcttttttgcttgagtgtcagatcaatgccacgattactttactgatactctttggagacgagatactgcttctttttagactttgaggtggtgattttatgtgaaaagttgcccgcttcaaatttcctattgtgcttgttcatagtctcttgtgctcgattttgtgtttttgtaactttctttatgacgtaaatagatttttctcgtgtttttcagggcctctcgtaatgggtgttgagatgttgtggtggtctttgggcatccttcccttcggttgcatggtcactgccattctgaattttgttcgtgatccgatatctttcgtctttctatttatggtaacggggagctatatttttcatatagctgtgctatactctattgtttattggcatcagtacatgccttaccggttaattggtgccaaggcgaaatttatgattgaggtcattcctatgataactgcagcagccttgcatcaccttttggagttcaattatgggcatctcgctctactgctatgctgcaccacatatttttactcctttgcccacttcttgcacttagcatatgatatcgggggaatagacgtattgctgggaatagtcatgcaggttcttgcttacatgctgaacgtaggattgttagctagagctttggctttgagcttctgctttgttttatgtttctatagatacatgacgtattgtgctcctgaactacctgttcatcataaaaaggagttggagcagctaccttgttgatctgtatgtactttttgaaagtaatagagaaacttgcaattaattttttgtcatgtaatcttctttttgtctgtttaatctatcagggtttctttcaccttctttagccgagggtatatcggaaacagtctctccgcccttccagggtagaggtaagactgtggacatcctgtcctccccagactctacttgtgggattatattggatggtggttgttgttgttgtcatgtaatgagcccttggttcacacctttgctcttcttgctgacatgcaggttctttaattttttttattcccatgaaaaagtagaataactaatcccggaataattaatcctgatataactctttccaaccaaatgacccctaagggttttaagtcgttggatactgtataatacaaccattggaaaacagacatcatcaaagaaaaaggtcaaaacttgaaactacaaaaggaaaaagagaatttcaatttgtcaggtatatttaaatttcaaatcacttttatatatatcaataatacgcgacataattcaagaatttaataaatagtaaaacatttttatacaatattttaaaaagggcgaatacgaggcgagatattttactgtatatagcaaggtgcaagcctcgaggcattgggcttgagccccgtgtgtttttacatttttaatattttaaaattaatataataaaataaatactaaaataagacaaaattacaaagagattttagaaatttcaagaaattataaaataaatgatacaattactttatcttaaaaagctaatttgctcagcaattgactaaaaattaatccaaaattgcttcatacaaaaattatcagactgaaaaaattgagtagaaatttataactaacttaaaagagcaaaataacttaaaaataaagaacaaaagaaggaacataaatcagaagctttgaaccagagcgaatcatgaagatatgtttttattttgtagtttgcaaataggtaattttttctttacgatgtaggacatgaagagagaataaaatttacggggtattgtgaattataaaaattgtgaatgtttgatttgaattcttattccaaattagaataccataatatgtttggtttgaataatgtattttaaattagaatatttttgtatattttcagaataaatgggaatatttggaggtatatcatgtactaatacttttgggattaatgtaattttaaaattgaggtatatcatgaaagtaaatctctcgaattggtgtacagacagacctctctataacaacgtccctatacaatagtcattcattataaaagcataatttttctcagaattgatcttttataatatactttatctctatataatagctttctgcctataaagcaacaaccatctttatgagagtacgctccttttaaaataactcctctataacagccatgtagattttctaagattattattaattataattctaaatattttaatgaaatattttataactttaatataaaatttataatagaaatatatatcttaaagataatagtacgctccatgaaaatatgcacattattattatgttttttttttaagttctaaatgatatgtttttctttagaaaaataccaaaagatacttaaaagatttgtctatactttttgaagataagcatatcattattttttttgattcaattgttaagctcttagattgccttcaaggaaaaataattggatatccttttgctgaaagtttggatgcaaatcttcgccgattcaagcgttataccgctagtacgagactggaatctacgaaacaagctacaattatggagttcttccatcaatcttcaaagttttaattgtgcgccttagagtttaatgtttgtacgtttagttatgattttttaaaaaaatgtattagatttatttagcatttaattcgtgaaatattcatatcttttgagattttgaatttgaatatctttttacctttatatgtaatattaaaaaattaatttttttgatatttttgtctgtaacatccaaaatatattcaaacgccaaatgttattataggtgtgtaacaatcattcactataaaagccaaaacttttcagaacaaacgatgttatagagaagtttggctgtatatcataaaacctttgcctaggcctccaattctttgtgggccagttttcctttacgaagaattaacacaaataaccaccccttaatttcttaaattaaaagtagttggcggatgtataatggtaaagttcaagtataatatgtgtataactgtatataaataatatataatctatatataacggttaaaaaatgtaaactgtgaatctggccggttatttgtgtaacaatccctttctttattgtgtctttatgattaattttctttttcaaaattattgaatatcataaggtaaaaaagtataaaatagttatgtaatttgtattttcttttcttctcttactaatttattccttcgaaaacaaggcaaatgacataaattaattttacatttattgtcattatttcttatattttcagcgcgataacaagcaaaatgaattagaatagtgaaattcttctgctttggagtttttacttcataggtgtatgtcacgacccgaaatttccaccatcgagagtcgtgatgacacctactaataggagataggcaagccaactcttacttatatatccatttttagcaacacttattttaaaacaattagcaataaataatacgaatattggggagtaattaaaattagcggaagactttataaattactagatgcggtactgaaatcccaacataaaatactaccaaagaactggtgtcacaatactcactaacttctaagaataatacacataatggtctgaaagaaatataatattgtttgtctcgaatacatgagataacagattgaaagtaagacagaagaaacgccgggtcctgcggacgcctgcaagactacctcggtgtctcaaaatgaccaaaggataacacccgtgctactaccgctgctgctgtccaagacatgtatctgcgcaaaaagagcgcaaagtatagaatcagcacaaccgaccccatgtgctggtaagtgcccggcctatcccggcgaagtaagtgacaaggctaggaccagacactcacataaacctgtacagttcataatatacatatataccgcaacaatcacagaataataacaattaatatctggggagggaaatcatgctctggggtaacaacaagatataatggcagaatataatcataaaaataaaggaatctcaattaaggagaacgggtaaatcaatatctgcacggcaccaaccatcgttcttttactctcgttctcaccaatacaattatataaagtacacggcaacacccatcgtgcttttcctcccatactctcatatcaagacacgtaatgatccttcgtgcataaatattcataacatggcacggaatgatccttcgtgcataaatattcataacatggtacggaaagacccatcgtgcataatcactcttcctcgccaattcaataatcacaaccaatcagggcgagggaaataaatagataatattaaatatcccaataagggagaatacaataacatcagtcaatacgttccagcaagggaacaattatatatctttttcttcttattcacttcttactaaattctcatatcatcatttgagccaatgctctagggaaattatcttttataatttccttctcacacttatcacattatttatggtttaacaattaagtgcggaaaagtcacatcaatatcaaataatcacgagtaaagactcacggtcatgctagacccccaacatatggatacttgtcaccatgcccatacgtcggactccgcacatagcaattagcaaatagactcactcatattccctcaagctaggatagatcaaacacttacctcgaaggtttacggcaaattcaatccttaagcaatgccctttcctttcgaatatggctcaaattcaattgtatctatacacaattgatttaatatcatcaattctactcaacaaaatattccaaatggctaaatatacatttcacaacattctgccatgaatagtgaaaattgacccggggcccacgtggccaaaacacgaggttcgaaccaatttccgacaacccatacaaccacgagttcaaccatgccaaaattactaaatttcgataacatttcgaccctcaaatcctcaaatctattcgagagggtttctaagctttttcccgctaaattcacggatttaatgccaaaacttgcaatagattcgagtaatataaccaaaattaagttaagaacacttaccccattgttctctccaaaaatctcccgaagaatcgccttatccgagctccaaatgggtaaaaattcaaaatggtttgtcccatttttagaaacaaaacattctgccaaaaatttccgaggttactgttcacggggtactgttcacaggtactgtatatggtactgtacacggggtactgtacacaatactgtacacggggtactgtacacagtactgtacatggggtactattcacaaggtactatttctgcaatttttttgaaaattttcctaagtccgaaatcactccgagacacctccgaaacactcccgagccctcggggctccaaaccaaatatgcacactgactcaaaaacatcatacgaacttgctcgtgcgatcaaatcgccaatataacatcaaaatcaatgaattaaaccttaaatccaagaaatctttcaaaatttcataacttccaaattttccaatttaaggccgaaacacgtcaaacaacgtccgttttcaaccaaactttacaggaagcgcttaaccaatatatatgacctgtaccaggcgtcggaaccaaaatatgagcccgataccattgctttttgatcaaattttattttcattttccttaaatattttcagaaaacaatttcacggaaaaattcatttctcgggcctgggacctcggaattcaattccggaaacacgcccaagtcccatatttttatacggattttccgaaattgtcaaatcacgggtccgggtccgtttacccaaaatgttgaccgaagtcaactatatcaatattaatatcaaaattcttcaaatttttcacataattcatatatttcaacatgaaaattttcctgcttcgcgcccggactgtgcacgcaaatcgagacaactaatagtgatgtttccaagacctcagaagctcgaaatgactaataaaacaagtgatgaccctttgggtggtcacattctccacctctaaagcaaccgttcgtcctcgaacggacaaaataaagaagtacctgagtcagagaatagctaaggataacggctccgcatatcagactcggacttctaggccgatgcctccggaggttgacctctccactgaacacgcacagaaggaaaactcttcgacctcaactatcaaacctgccggtccaatatagctaccggttcctcctcatataagatagatccttgtctaattggacagtgctgaaatttaacacgtgtgatggatcgccgtgatatttccagagtatggatacatgaaacactggatgcacagctgacaaattaggtggcaaagcaagtctataagccacctttcccacacgatcaaggatctcgaatgggccaataaacctagggctaagcttgcccttcttaccaaatctcatcatgcctttcataggcgacacacggagcaatactcgctcaccaaccatgaaagccaaatctctaaccttgcgatctgcataactcctctgcctggactgagctatacgaagcatatcctgaataatctggaccttatctaaggcatccttgactatatccgtacccaacaaccgagcctctccctgctcaaaccatccaaccggagatcgataccgtctaccatacaaagattcataaggagccatctgaatgctcgattgatagctgttattataagcaaactctgctaaaggcaggaacgaatttcacgaacctccaaaattaataacacatgctcggagcatatcctccaatatctgaatagtcctctcggactgaccatctatctggggatgaaatgctgtactcagctgaacctgggtacctaactctttctgaaatgccttccagaaatgcgaggtaaactacagacctcggtccgaaatgatagatataggcaccccatgaaggcgaacaatctccctgatataaatccctactaacctctcggacgagaaggtggtggcaacaggaataaaatgtgctgacttggtcagcctatccacaataatccaaactgcatcaaacttctcctgagtcatcgggagaccagtaacgaagtccatagtgactcgctcccacttccattcaggaagctcaattctctgaaataaaccactaggtctctgatgctcatatttaacctgctgacaattcaaacaccgcgccacatacgcaacaatatcctttttcattctgcaccaccaataatgttgccgcaaatcctgatacatctttgctgcgcctggatgaatagagtgccgggaactgtgagcttcttctagaatcaatactcgaagcccatctacatctggtacacaaattcgcccttgcattctcaaaactctatcagcatctaaggtgacctgcttggcacctcctcgctgaactggtctttaaggacacataaatgacgatcatagaactgaagatcgcgaatacgctcaaataatgaagagcgagcgaccgtgcaagctagcactcgactaggctcagaaatatctaatctcacaaaatgattggctaaggcctaaacatccatagcaagcggcctctgactaaccggaatataagcaagactgcccatactggctgacttcctgctcaaagcatcagccaccacatttgcctttcccgggtgatataaaatagtgatatcataatctttcagcaactccaaccatcttctctgcctcatattcaactccttctgcttaaacaagtactgaaggctcttgtgatcagtgaatacttcacatgccacgccatacagataatgcctccaaatcttcaatgtgtgaacaattgctgccaactccaaatcatgaactggatagttcttttcatgagtcttcaactgcctcgaagcataggcaataaccttgccatcctgcatcaacactgcaccaagcccaatacgggaagcatcacaatatacagtataaggtcccgaacttgtgggcaaaaccaacaccggtgctgtggtcaaggctgtcttgagcttttgaaagctcgcctcacattcatctgaccattcaaactggacacccttctgggtcaatcaggtcatcggggttgcaatagatgaaaacccctccacaaaacgccgataataacttgctaatcccaggaaactctgaatctccgtagctgatgctggtctaggccaattcttgactgcctctacctttctgggatcaacctggatacctgccgccgtcacaacatgacccaaaatgccattgaacttagccaaaattcacacttcgaaaattttacatatagttgactatttcttagagtctgaagagccactctgagatgctgcgcatgctcctcctgactgcgggagtatatcaatatatcattaatgaagacgataacgaacaagtctaaataaggcctgaatactcgattcatcaatttcataaaagctgttggggcatttgtcaacccaaaagacatgactaggaattcataaatccgtaccaagtgcggaatgctgtcttaggaactcctgctgccctaatcttcaattgatggtagtcagatctcaaatctatctttgaaaacaccttggcacctagaagttggtccaatagatcatcgatccgcgacagtgggtacttgttcttgattgtaaccttgttcaattcccagtaatcaatgcacattcgcatcgaaccatctttcttcttaacaaataataccggtgcaccccatggcgaaacactggatctaatgaaacccttttcaagtaaatcctgcaactgttccttcaattcttttaactcccaattgtttttagaaatttcggcagagtatcccctataattggacctatccacctgccagggtgataccaaaacaactcctagcaatatttccacaacccgacaacgcaccataaagtatatatcaaacagaaatggctaaatatgaatagaaattatacaaaaatttatcaaataagcctaacaggcatgactccatttaaaatatagaataagatttttatttttcataaaaggaaaattttaaacacataaaaaaaatttccacccccaggaccttgtccttatataaccttcaccgcagcttctagctcggtttaaaaatgtttcacattacataaaattttgaggatctcatcctcaactctgaatcacgagtattggcacattatacccactggaatcttttatttcctttctttcttctttttcaataaatttccaccaaggaatatcataacataaaatgaaccctcataccgatagggcatataattgacaattgaaattaattatccaaaatttacatcaaaacccactgtagcaagtaatataaagtcacttttagaatcatagctttcttattgactaacacataataatagggatagctatctccacataatagcccaacgtgagtattcatataagtaggttttaaaattatgaagttcgctcataagtggagcgcaataggaggacttgcctcgatactcagaacgaatcaagttaacaaaattgttactttactataattcgagattgaactcataatgacaccatctggtgttgcgacctcagccttaccatagaaaatatattaacggctgggtctccacctctaggagtctcacctccacatctaatctcctgacccctacctctggctggtcatgtaagcttagtattggctgcaacgaggcacgtagcctgcgtgctttcataaattatacttctccattctaccacattcacaataattcctttgaagctcagctaacttattgaacctgatgacatattcagacactgtcatggtgacctggtacaaccgttcagatcacatataccacatattgcagagaatctggaaggtcaatcccttcagaatatttcttaaaatagaattgagtaggtaatgttgcattggccagactgctttctttgtaggcttttcacaaacaccaactgtcaatttcctcttttgctatgctggcttgacactgctgagctaccccatttattcatatacacttcattataccttgggggcgattcttaccccctgcaaagtaccaaaccttaaatatatataattgtttaggagacttttccgtaccatatatatatatatatatatatatatatatatatatatatatatatatatatatatatatatatacattccaagccaaaactgaaataacacatggccatacaacccattcactaatagtggaattccccatttggcgctaattcaaagatacaacgtctaataatccacaatatttgtccttcacaaatcaaataaatcaaccagacgtcaaggttcgttgaacccttgcatgattcattaggtgatctcctgatacgtctatatcttccgttggaaccacaactggttagtagatacattatcttcccactacttcatttgccatctgaagcacagtagaatcaatcccctcgctttcgactattcccacgttctgcaatacctcatagtagcggttaagaatttcctgtgggttctcaaaagatgcaccgctaaaagtggtagcgaagaatttggtgaaacctatccgacctccgcaaaacttctgaaggcatcgttgatctataaccaacatgtgccattcttcggctgaagaagcggtacgtgacttcgccattcgtgggaagacaagagtagaaattcaattagattttgaagaacaattcgcacgacagaaatgaacaaagatgaaatttttcctaactccgtagcctctggggaataaatacagacgtctccgtaccgatacctcagactctaccaaggttgttcgtgagttgtgagacctatgtaacctagtgctctgataccaacttgtcacgacccgaaattcccaccatcgggagtcgtgatggcacctactaataataggagctaggcaagccaactcttacttatatatccatttttagcaacacttattttaaaacaattagcaataaataatacgaatattggggagtaattaaattagcggaagactttataaattactagatgcggtactgaaatcccaacataaaatactacccaagaactggtgtcacaatactcacgaacttctaagaataatacacataatggtctgaaagaaatataatattgtttgtctcgaatacatgagataacagattgaaagtaagacagaagaaacgctgggtcctgcggacgcctgcaagactacctcggtgtctcaaaatgaccaaaggataacgcccgtgctactaccgctgctgctgtccaagacatgtatctgcgcaaaaagagcgcagagtgtagaatcagcacaaccgaccccatgtgctggtaagtgcccgccctatcccggcgaagtaagtgacaaggctaggaccagacactcacataaacctgtacagttcataatatacatatataccgcaaaaatcacagaataataacaattaatatctggggaggaaaatcatgctctggggtaacaacaagatataatggcagaatataatcataaaaataaaggaatctcaattaaggagaacaggtaaatcaatatctgcacggcaccaaccatcgttcttttactctcgttctcaccaatacaattatataaagtacacgacaacacccatcgtgcttttcctcccatactctcatatcaaggcacgtaatgatccttcgtgcataaatattcataacatggcacggaatgatccttcgtgcataaatattcataacatggcacggaatgatccttcgtgcataaatattcataacatggtacggaaagacccatcgtgcataatcactcttcctcgccaattcaataatcacagccaatcaaggcaaggaaaataaatagataatattaaatatcccaacaagggagaatacaataacatcagtcaatacgttccagcaagggaacaattagatatctttttcttcttattcacttcttactaaattctcatatcatcatttgagccaatgctccagggaaattatcttttataatttccttctcacacttatcacattatttatggtttaacaattaagtgcggaaaagtcacatcaatatcaaataatcacgagtaaagactcacggtcatgctagacccccaacatatggatacttgtcaccatgcccatacgttggactccgcacatagcaattagcaaatagactcactcctattccctcaagctaggatagatcaaacacttacctcgaaggtttacggcaaattcaatctttaagcaatgccctttcctttcgaatatggctccaattcaattgtatctatacacaattgatttaatatcatcaattctactcaacaaaatattccaaatggctaaatatacatttcacaacattctgccatgaatagtgaaaatcgaccccgggcccacgtggctaaaacacgaggttcgaaccaatttccgacaacccatacatccacgagttcaaccatgccaaaattactaaatttcgataacatttcgaccctcaaatcctcaaatctattcgagaggttttctaagctttttcccgctaaattcacggatttaatgccaaaacttgcaatagattcgagtaatataaccaaaattaagttaagaacagttaccccattgttctctccaaaaatctcccgaagaatcgccttatccgagctccaaatgggtaaaaattgaaaatgggacaaagtcccattttcagaaacaaaacattctgccaaaaatttccgaggttactgttcaccccgtgttactgttcacaggtactgtacacggcactgtacacggggtactgtacacaatactgtacacgggggtactgtacacggtactgtacatggggtactattcacaaggtactatttctgcaattttttttggaaattttcctaagttcgaaatcactccgagacaactccgaaacactcccgagccctcggggctccaaaccaaatatgcacgctgactcaaaaacatcatacgaacttgctcgtgcggtcaaatcgccaatataacatcaaaatcaatgaattaaaccttaaatccaagaaatctttcaaaatttcacaacttccaaattttccaatttaaggccgaaacacgtcaaacaacgtccgttttcaaccaaactttacaggaagcgcttaacaatatatatgacctgtaccgggcgtcggaaccaaaatacgatcccgataccattgctttttgatcaaatttcatttttattttccttaaacattttcagaaaataatttcacgaaaaaattcatttctcgggcctgggacctcggaattcaattccggaaacacgcccaagtcccatatttttctacggattttccgaaattgttaaatcacgggtccgggtccgtatacccaaaatgttgaccgaagtcaactatatcaatattaatatcaaaattcttcaaatttttcacataattcatatatttcaacatgaaaattttccggcttcgtgctcggactgcacacgcaaatcgagacaactaatagtgatgtttccaagacctcagaagctcaaaatgactaataaaacaagtgatgaccttttgggtcgtcacattctccacctctaaagcaaccgttcgtcctcttacggacaaaagaaagaagtacctgagtcagggaatagctgaggataacggctccgcatatcagactcggacttccaggtcgatgcctccagagattgacctctccactgaacacgcacagaaggaaaactcttcgacctcaattatcgaacctaccggtccaatatagctaccggttcctcctcatataagacagatccttgtccaattggacagtgctgaaatttaacacgtgtgatggatcgccgtgctatttccaaatatgatacaagactgttcataaactgagagtacaaaggaaaaacaggaaataaagatagagggaaggagagtcgatgactgcgaacgccgtgcagctacctcaacactccgaactgctgatgcatgagaattgcaagatctagcccgcctgagagtgccctggatctgcacacaaggtgcagagagtaatgtaagtagtccgacccagtgagtaataacagaaaataaagctctgaaggcaagaaaacacagtaataacacaaagtaagacaaatagtagagtataacaatatccgaaactgaacaactgaacaatatatatatatatatatatatatatataggatgcaaatgcagggatgcgatgcaatgcatatgatggtacaatccaatacccgctgcggcgtgcatcccgagccacccatatcatttatcgtcgacgacgctcactagggggtatgtacagactccggaggggctcctacagcccaagcgcaataaccagccatctagtggcgaataagcaaaccaggtcagtccaagttacctaaccactcatatcatacagtgtccaagttaccattgtttccaatcaccgctgcggcacgcagctcgagccacccaaaatcagtccagaaaatatatcacaagccccttgggcaattataaaccatgatcctcagccgaaatacatttaaaagatagaaatagagttttgaacattagaaatacggctgggttttgaaaacagtgttttaaaaccatgtactgatggtaaatgatatgcaaatcatgctagacagtaataccaactcccgaaggatactacaggtcggcactaggccccaaacacggcataaagcccaataataacatcacagtgtgcgtatcatacgccaatataatataaatctcactcgggatggaccaagtcacaatccccaatggtatccgaccccgcacttgtcatggagtgcttgttacgcctcaatatagcgttacgatgtgaaagtccagggtttcaaaccctcagaacaacatttactggcattactcacctctagtcggccgtagactagctcgaaatgccttttcccttcaaattctcctctacgagcgccgaatctggccaaaaccacaacgaatacattacaataggctaataggatataacccaatcgaaagaactcgaaaaacatcaaaattcatgaaattagcaaaacccgagcccgggcccacgtctcgaaatccagaaccaaaatgaccctcgtctttccacgagtctatacatataaaatttatcaaaatcggagtccaattgctcctccaaatccccaattttcatttaaaatttcaagccctagttcttcaatatttacaccgaatttcagtgaattaaaggacgattcttcgataaaatgacgtaataagaccacgagacttacctccattcacttcccattgaaatccccttcaaaatccgtcaaagagctctcaagatatggtaaaaatggaggaaaaagtgatgaagctcgcggacaaaacaacttaagttaaaacactgcccagacgctcccttcttcgcgaacgcgaggcccagacgcgtccgcgaaggccatccagaactgggcccagaaatccttcaccgcgaacgcggagcccagccgcgatcgcgaagcccaagccccttcctcaaacgcgaatgcgatcccatcccgcgaacgcgaaggccaaaggccctgggttccacctccatcccattaccctacgcgaacgcgagcccagtcagcgaatgcgaagaccaggagctctcaggcctacgcgaatgcaaaggcctcacgcgatcgtgaagagctttccttacctgcagctgctgctgcatttctgcaacaccccacaaccaaaaaccaatccgttaagcatccgaaatcaccccgaggcccccgggacctccaccaaaagcacaaactcaacctaatacttcatttaaacttgctcgggccataaaaacactaactttaacctcaaaaaccaccaaaatcatagaatttcactctaacttaaacttagacttaacaaaattatatccgatgccgaaaccaaccaaacgaggtccgaatgacttgaaaatttacacacatacccaaattcacctaacgaagctattgcaactttcgaaattccattccaaccctcggatcagattctcacccatcaaccggatttcttcaaaattccaacttcgccaatctaagctaactttcacaccggacctccgaattcacttccgttttcactcctaagtcacatatcatcccccaaaactagtcgagccattgaaaatccattccgagccctttaacccataagtcaacgtcgggttgacttttctaacttaggctttccttaaagagactacttgtctcatttctaaccaatttccacccaaactacttcaatctcaccaagaacgcataacaacacacagggaaatatataacggggataacagggcagaaatgcaagaaatgactggtcgggtcattacatcctccccaactaaaacaaacgctcgttctcgagcaggtcaagaaatatacctgaagcagtaaacaagtgaggatatctgctctgcatctcctgctcggtctcccaagtagcctcctccacgggacgacctctccactgaactttcaccgatgctatatcgttagatctcaacttgcgaacctgacgacccaaaatagccactggctccacatcataagtcaagtcatcatccaactgaaccgagctgaagtccaaaatatgggacgggtctccaacatacttccggagcatagaaacatgaaacaccggatgaactccagacaatctgggtggcaatgcaagcttataggtcacctccccaatcctgtcaagtatctcaaaaggaccaatgaaccgaggactcaacttccctttcttcccaaacctcataacgcctttcgtaggcgaaaccttctgtagaaccttctcgccaaccatgaaagatagatctcggactctccgatccgcataactcttctgacgcgactgagctgtacaaagccgctcctgaatcactttcaccttctccaaagcctcctggaccatatccgtacccaataatttggcctcgccgggttcgaaccaaccaaccggagatctacaccgtcttccatataaagcctcatatggcgccatctgaatattggattggtagctgctattgtaagcaaactctgcaaggggaaagaactcctcccaagaaccaccgaagtcaatcacacaagcacgtaatatatcctccaatatctgaatcgtgcgctcggactgtccgtccatctgaggatgaaatgctgaactcaaatcaaactgagtacccatctcacgatgaaaagccctccaaaactgagaagtgaactggggacctctgtctgatataatggaaaccgggacaccatgcaatcggacaatctcacaaataaagatcactgccaaccgctccgaagaataggtagtacaaactggaatgaagtgtgcggacttggtcagccgatccacaatcacccatatagaatcaaacttcctcgctgtccgagggagaccagtcacaaaatccatcgtgatcatttcccatttccactcaggaataaccatctgctgaagaaaaccaccaggtctctgatgctcggacttcaccggctgacaattgagacaccgagctacataacccacaatatcccttctcattcttctccaccaatagagctgcctcaaatcctggtacatctttgcgacccccgaatgaatggagtatcgcgagctgtgagcctctgccaatatcatctcccgaatcccatctacattgggcatgcaaatacggccctgcatcctcagaacaccgtcaccatcaatagtcacatccttggcatcgccgcgctgaacccgatccctaagaacaggcaaatgccggtcattatactgatgctctctaatgtggtcatacaaagaagactgagaaaccatgctagccaacacccggctaggctccgaaaaatccaaccgaaccatccgattaactaaagcctgaacatcaacggtaaggggtctctccccaactggaatgaaggccaaactgcccatgctaactaccttccgactcaaggcatcggccaccacattggccttccccgggtgatacaatatggtaatatcatagtccttgagtaactcgagccacctccgctgcctcaaatttaggtctttctgcttgaacaagtgctgaaggctgcgatgatccgtgtacacctcacaagatacgccgtagcgatagtgcctccaaatcttcaaggcgtgaacaatagctgccaactctaagtcatgaacagggtagttcttctcatgcggcttcaactgccgagaagcatatgcaatcactctaccctcctgcatcagaatgcatccgataccaacccttaaagcatcacaatataccgtataagaacctgaagctgttggcaatactaacactggagccgtagtcaatgctgacttgagcttctgaaagctctcctcgcactcatcagaccaaacaaacggagcattcttctgcgtcaatttagtcaatggcgacgcaattgatgaaaaaccctcaacgaacctgtggtaataccccgccaagcgaaggaaactccgaattacggtggccgaagatggtctaggccaactctgcactgcctccactttcttcgggtctaccagaatcccatcacttgacaccacgggtcccaagaatgccacagaactaagccagaattcacacttggagaacttagcatatagcttcccctctctcagcctcagcaatacaactctcaaatgtcgtgcgtgctcctcctggctacgcgagtacaccaggatgtcatcaataaacacaatcacaaatgaatctaaatacgaccgaaacacactattcatcaagtgcatgaatgcagctggggcattagtcagcccaaaaggcataaccagaaactcataatgcccatatctcgtagtgaaagctgtcttcataatatcagaatcccgaatcttcagctgatgatagccagaacgaagataaatcttagagaaaactttagctccctgaagctagtcaaacaaatcctcaatacgaggcaaaggatacttattcttcacggtcactttattcaactgcctgtaatcaatgcacattctcattgtgccattcttcttcttcacaaataacacaggtgcaccccacggtgacacactaggacgaataaaccccttttctaggagttcctgaagctgatctttcaatttcttaagctctgcgcaggcaccatgcgataaggtggaatagaaatgggctgagtgcccggcaccaaatcaatcccaaaatcaatgttcctgtccggcggcatgcccggtaggtcagctggaagcacgtcagggaaatccctcacaacggggactgaatcaagactaggagtctcagctccaacatctctaacaaaagccaagtacgataaataacctttccctaccatccactggcctttaggaaggaaatcaccctgctaggtacaaaatcagtcacacctttccactcaactctcgggataccaggaatagccaatgtaactgtcttagcatgacagtccaaaagagcacgatacggggatagccaatccatacccaaaatcacatcaaaatccaccatgcccaataataacaagtcaacacgggtgtccagacccccaaatgaaatcaaacaggatcgatacacatgatccacaacaatagtatcccccaccggagtagatacatgcacaagtgaaacatgacaatcacgtaccacaccaagatgatgggcaaaatagcatgacacataagaataggtagatcccagatcaaataaaacagaagcatccctgtgacatactggaataatacctgtgataacagtatcagatacaatagcgtcggctctgtctggtatagcatagaatctggcctgaccaccgccagtccggcctccgccagtccagcctccgcccctgggatggcctctggctgcctgccctccacccctagctggctgggggggaggggggtagatgaaaccggtgcagaagatgagggctggtctctgctgagatctaccaccgcgaagtctaggacaatacctcttaatatgaccaaactcaccgcacttaaagcaaatgtctggagctggagaaggggactgaagggaacccctcgcaccagaatgaccagtcgacccactcggcgcagaagaaccctgagctgaaggagcataggataaaccctgtgcagggagtgcactcagtgaagactgaccctgctgtgaaccttgtgaccacggcctgaaggcgccccgcgatactcgggatgggccggctgctgctgcctaaaagggcggcctctaccctgctggaactggcccctagacggagcactgctgaaactacatgatccacgagacctcttagcctctctctcctttctctcctgacggtgatctgcctcaaagtccatagcaatgtcaacagcatcctcaaatgtatggctcagaaccctctctagacatcagaatacggataggatagataagcccgtccacaaatctcctgatcctctcccgatcagtcgggaccatccatggagcatgacgagccaactcaaaaaatctcatctagtactgtgacactgtcatatcaccctgccgaaggtactcaaactacctacgcagctcctctcgctgagactgtggtacccacttctccaggaagagagtggagaactctagccaagataacgatgttgctcctaccggcctacaccgctcatatacctcccacaatgtgaatgctgccctcatgaattggaaggtagtgaatgatacaccgctagtctccaaaatccctgctttctggagcatgtgtcgactcttgtcgagaaatccctgggcatcctcgccctgagcaccactgaaggtcggaggtgaaagtctactgtacctatcgagacgacgctgctcatcctctggcatagccggaaccataacatcctgaaccggagcaacctgtgggactggcgcaactggcgcaactggggcaaccggtgctcgtggagcaactggagcaataggggctgcctccggggtctgcaagtccagaacaacctactctggagtgtgagctgcaggggtctgatgtccaccccctgtctgagatgtggctgctgcagtagaagctgataccgtgtgagctaggccagttcaaaccgatagaatctgggctagggcctcctaaagacccggaatcacaatgggcatagccggtgcctgagcatgcactgttggagtctcaacagctggcgtctgatctagaacctgggcagctggtggatcaataggtgctacctctgcggcactgcctcgaccgcatccacagcctcatccacggcctctggtaggtggtactgttggtcgtccggcacctcgggtagcacgtgttctcgccatctgcgagagaatagaatagtagaatttagttctaggatcaacaaagtcgcaagaaaagaatttaaagaacatgaagtgtttcctaagagttctgcagcctcgcgaaggtctgatacggacgtctatgtaccgatcctcgagactctactaaaccggctcatgacccgcgagaccaagtaacctaggttctgataccaagttgtcacgaccccaaacccggtcgcgatggcgcccgaccgtaaggctaggcaagctcgacctcaataccaaaaatcccagatgaaggaaatttaacaaaacaataacttagaaaaataagagatttaactcccaaaaacagtggaaatctgaataccaacaataaaccacctaggaaccgctgtcacaagcctgagcctgtagagtacaaatcaaatatgatacaagactgttcatagactgagagtacaaaggaaaaacaggaaataaagatagagggaaagagagtcgatggctgcgaacgccgtgcaactacctcaacactccgaactgctgaagcctgagaactgcaagatctagcccgccttagagtgccctggatctgcacacaaggtgtaggaagtaatgtaagtactctgacccagtgagtaataacagaaataaagctctgaaggcaagaaaacacagtaatattacaaagtaagccaaagagtagaatataacaatatctgaaactgaacagctgaacaatatatatatatatatatatatgatgcaaatgcagggatgcgatgcaatgcatatgatagtacactccagtacacactgcggcatgcagcccgagcgacccatatatttatcatcgacggcgctcactgggggtgtgtacagactctcggaggggctcctacagcccaagcgcaataaccagccatctagtggcgaataatcaaaccaggtcagtccaagttacctgaccgctcatatcatacagtgtccaagttaccactatttccaatcaccactgcggcgcgcaacccgagccacccaaaatcagtccagaaaatatttcacaagccccttgggcaattataaaccatgatcctcagccgaaatacatttaaaagatagaaatagagttttgaacattagaaatacggctgggttttgaaaacagtgttttaaaaccatggactgatggtaaatgatatgcaaatcatgctaaacagtaataccaactcccgaaggatactacaggtcggcactaggccccaaacacggcataaagcccaataataacatcacagtgtgcgtatcatacgccaatataatataaatctcactcgggatggaccaagtcataatccccaatggtatccgaccccgtatttgtcatggagtgcgtgtcacgcctcattatagcgttacgatgtgaaagtccggggtttcaaaccctcagaatagcatttactggcattactcacctctagccggccgtagactagctcgaaatgccttttcccttcaaattctcctctacgagcgccgaatctggccaaaacaacaacgaatacattacaataggctaataggatataacccaatcgaaagaactcgaaaaacatcaaaatttgcgaaattagcaaaacctgatccccgggcccatgtctcgaaatccagaaaactttataccaaaacgaacctcgtctcgccacgagtctatacatataaaatttatcaaaatcggagtccaattgctcctccaaatccccaattttcatttaaaatttcaagtcctagttcttcaatatttacacccaatttcagtgaattaaaggacgattcttcgataaaatgacgtaataagaccacgagacttacctccaatcacttccagttgaaatccccttcaaaatccgtcagagagctctcaagatatggtaaaaatggaggaaaaagtgatgaagctcgcggacaaaacaacttaaattaaaacactgcccagacgctcccttcttcgcgaacacgaggcccagacgcgtccgcgaaggtcatccagaacagggcccagaaatccttcaccgcgaatgcggagcccagccgcgatcgcaaagcccaagccccttcctcaaacgcgaacgcgatcccatcatgcgaacgcggaggccaaaggccttgggttccacctccagcccattaccctacgcgaacgcgagcccagtcagcgaacgcgaagaccaggaactctcaggcctatgcgaacgcgaaggcctcacgcgatcgcgaagagctttacttgcctgcagctgctgctgcatttctgcagcaccccacaaccaaaaaccaatccgttaagcatccgaaatcaccccgaggcccccgggacctccaaaaaagcacaaactcaacctaatacttcattcaaactcgctcgggccataaaaacgttacctttaacctcaaaaaccaccaaaatcatagaatttcagtctaacttaaacttaaacttaacaaaatcatatccgatgctgaaaccaaccaaacgaggtccgaatgaccttaaaatttacacacatacccaaattcacctaacgaagctattgcaactttcagaattccattccgactctcggatcagattctcatccatcaaccggatttctccgaaattccaacttcgcctatctaagctaactttcacaccggacctccgaattcacttccgttttcactcctaagtctcatatcatcccccaaaactagtcgagccatcgaaaatccgttccgagtcctctaacccataagtcaacatcgggttaaattttctaacttaggctttccttaaagagactacttgtctcatttctaaccaatttccacccaaaccactttaagctcaccaagcacgcataaaaacacacgaggaaacatataacggggataacggggcgaaaatgcaaggaatgataggtcaggtcattacaaaacatgtttcaaatccaaatcgaggaaataggtaaccatatgattctttcatggaaaatttccttagatttttgttattattaacaatacaatcttgagctataaaaaggcatgtagcaaactcaaataagtccaggcagcaatactagcatgcgcaaatgacaccgaggcgacaacccaatccaacagaaatgtaaattgtgcactaccgagggcccgaacggctcgaaccaatagatgcatctattttccccactcgcgaatcatccatgcgacgcggtaaacataaagtaaacaaataacctgctcgcgaatcatccatgcgacgcagtcaacatgaagtaaacaaataccctgctcgcgaatcatccatgcgacgcaggtacacacaggaatacatgctcaattagtcaaacgaggacttatcggggaatatttattcaaataaaatcatttccccttaacagttttaagaaatgaattttaatcctttttgaaattcatttactagttcaatttgacttaaacaattcaaatgccaacaaggttacaaatattccatatataacatgcttttgggtcctagtctacccggacaatagcataatagtagctatgcacggactctcgtcacctcgtgcgtacgtagcccccacaatttgtagcacataatcaatttaactcacctatggggtaatttccccctcacaagattagaaatgagactcaccttgctccgaagactcaatatcggcattctttattcctccaaagtcttgaaccaacacacaaatgctccagaactagccaaataacggcaaactaatgagaatatattcaaatactttctaacaattcaaattatacaatttcccaactcaattttgtgaaatgaccaaaatgccctcaggcccacgtgcccgaaatccaaaatttctcgaagataaaggttacccatgacctgaggaactcaaatatataatttactcctagttccatggtcaaattcgtggttaaattccaaaaccctagttttctaggtccttctctaacccttaatttttctacaattttcatgctaaaatccatggtataatcttgtatttaacttgggaatgagtagaaatagcttaccttgacattgatgatgaaatccctccttgaagctctccaaaatcgcccaatgaagtaaagaaaaatgagagaaatgaaccaaattcgcaacttaaatcaagcttctgcctccagacattttcgcttctgcggaattattggtgcttctgcgggcgtcgcttttgcgacttttggccgcttatgcggctttgggcaagagggagctgatcgcttctgctgtctgggggccgcttaagcggaaccgcttttgtggtcccttggccgcttctgcgattttcctgggccaagccccttccgcttttgtgcctcctcatctgcttctgcgggaccgcttctccggttccatttccgcagaagcggaaataccagcaactagcaaaactcaatttttcaaaaacccaattttcgatccgttaacctcccagaatccacccgaggcccccgggacccaaaccaatcataccaaccagtcccataacacattacggactaactcgaggtctcaaatcataacaaacaacgccagaatcatgaattacacctcgattcaagctttataaactttgaactttccaacttcaactttcgatgacgaaacctatcaaaatacgtccgattgacttaaaattttacacacaagtcatatgtgacattacggacctactccaacttccggaatcggattccgacctcgatatcaaaaagtccacttccggtcaaactcttcaaaaaccttcaagtttctatctttagccaaatggttccaaaataacctacggacctccgaattcactttcgatcgcgctcccaactccagaatcaccatacatagctactccccacctcggaatcccaaacggacatcaataacactaaaatgcaccttaagccaaactgatgcaatttcctctaaaatgctaacttccacaataggtgctaaaatacttttgggttatccaaaactcgatccgggcatatgcccaagtctgaaatcatcacacgaacctgctgaaaccttcggatcccgattccgaggtcatttactcaaaattccaatcctagttcatttcttcaactttaagctttcaagatgagaattctcttcccgaatcaactctgaacttttcgaaattcagttccgaccatgcacacaagtcaatataccttagatgaagcttctcatggcctctggctgctgaatgacgcgccggagctcaaaacaaccggtcgggtcgttataatctcccccacttaaacatacgttcgtcctcgaacgtgctgagaactacactgaagtagtctgaaatcacttgttaacacctcatgcaccttcctgtgcttccacaactcagtcgagcacattagctcgataactccgtagatatactttttcatttgagcaaataagccttaaagcccaattccaacatccggaatttcctgcccaacttgtcttcaacataggatcaccatatcaatcacttcacgttgtacccaagcatgactgcatagttgttgctgaattcacactttgcattactttactcatagggccacaataacactcttcaaatattatagccgaaattccacaaatctgatgctccctctacatctcatgacttacataggtcttactctagcttttgcaacactgatatgacggaagaggtgtcccaaaattcataaccaactactgaatcactaaatccttggatctatactcctggcaatatccattactttgtctcaaaccaataaatgatccttgctccttaatatacatcatataatcagattgcactgatcctaaatccaatagtctcatttcacccagtacaaactgcacaggtaataagccacctcggatataatcaaaagtcccacaagacgccataatgtgccagtaggctaccactcgaattgcgatacacaaaggaagcctaattttaaaagggagatctaattaccccgctcgcgaaccatatatgcgatgcaagcttatagctagaacttagaattctgggaaacataggagacataacacataaaagcaaatatgggggactgtattgaacacattacttctgcggcgcgcaactcgatccaaattacataaccatagcggtgtgccactcgacccacacaatataactatggcggcgtgccacccgatcgaaataacatacctatggcggcgtgccacccgatctaaaaatggaactcacataaggagatatacatcgagctaaattgctcattacaaaaaaataccgaatatcggtcatgggcacactaaggtgcataatatcatccctaagggaacacatagtgctataggctacaaaacctgagcacaagatgggtttctgtttaaggaaaataagttgtgtatccgttattgctctttacgtgaagtatttgtaagggaagcacattgtggaggccttatggggcactttggagtcccaaagacattagacatacttgctgaaaatttcttttagcctggaatgagaaaagatgttgaaagaatgtgcacacaatgtttgaaatgtaaaaaagctaaatctaaagtgttaacacatggtctttacacgccattacctgttcctacttcacattggattgatatttcaatggattttgtgttagggttgcctagaacaaggtatggtaaggataacatatttgttgcggtagataggttctccaaaatgactcattttagtccttgtttaaagaataatgatgcttcacatgttgctaatctttttgtaaaagaggttgtcaaattgcatggtatacctagaactattgttagtgatagggatactaagtgtttgagccacttttggcatgtattttgggggaagttaggccctaaattgttgttttctacttcttgtcacccacaaactgatggacaaactgaagtggttaatagaacgttaggaaacatgttgagggctcttttgaaaggtaaattaacttcatgggaagatcacttacctatgattgaatttgcttacaatagaacaatccattcttctacagatatgtctccttttgaggttgtttatggctttaatccctttactccacttgatttattaccattaccaactaatgatattgctaatcttgatggtagaacaaaggctgagatgatgaaaacaattcatgagcaaacaattcttgcaattgagaagaaaaatgagcaaactgccttgagaaagaataagggtcgaaaacaagttatttttaaacctggagatttagtttgggttcactttagaaaggagagatttccttccaaaaggaagtgaaagctgcatcctagaggagatggcccctttcaagtccttgaaaggattggagacaatgcttacaagctggaccttcctagtgagtttcaagtaagtgctacattacatgttgctgatttatctttgtttgatgtaggatcgaattcggggatgaattcttttcaagaagggggaatgatagaatcaaggacaaggatataattaaagacaatgatagagttttggaagctccaaggccatttactagatcacaagctaaagatttgcaaactaaggttgcttgacttcaatggaaaataaagaagcttttaattgtagaggaagaactcacgcccaaaggagatgaattatccaagttttacaattatttggtggtccaaattgaagtccaagatgaggaatattgtgtcaccaaattagcccttcaagtccacctaaagggctcaaaatgaccttaaaagaggtccaaaagggggtgtttcaaaaagagtcctattggagtccaaatcaatggcccaactagtagtttgaaggcccaaatctgccccaaaaggatttggccgccccccccccccacctaattttgatggcttttgttaccccttagtagccacctacctaagtttgatggctattgtgacccctagcagcccctacctaattagatgactttttagcaaccccttacattattttaagtgtttttactcctataaataaggggttcttctcattcataagagacaacatttttgattaagtatatcatcctttgagagttcttttgaacctttgttacttgtgctttgagatttatctttcaacctttactagttcatagttcaaggtagtaagatttcatctcttttatgatatctttgattcctttgtggtattcttagaaggcgattaatactagttattaattgttatctcaagttactcataaagcggtccagatccgaatctattattttgatttgcttttaagtaaaggcgtttgatttcttccataaatcaagacgttactttgatcttgtcaaggctatagaacttgcgttcttggatgtttttggaattctttccttgaattttcccatatcctttattttcatctctttaattctagttgttcaattccttattgttattgcttccggatttacttctcaaatacttactctattttggattcccgacctatctgttatcaagtggtattagagcggttctatcaagatttcgttcttggtaactcttggaatttcttgaatactaagagcaaagaaaagaaaagaattttttaaaaaaaaaaacagaaaaaaaggaaaatcaattgcttgctctccaaaaaattttctttgtatctaatttgtttccgaaagttagcaaaggaaacaagaagaggggatcctggatttgcttattcattctaatctacatatttatatcctttcctttttgttcgcgtcttgtttcaaccaagcctaatagttctaggatttggtttttctttcattagttctaaaaaaaaaatctgaattttactactaagaacttcatacaagttgggtttaactataaatctacaaagtatttttttccacggttattctgagagaaaaaaacaaaaaaagaagctaatttgtgtgatacaatttaattttttttttaaaaaaaaagatgtcgcatacatgtagtgatgatgaacgaagggttctccaagaagccgaaatcaaagcaagaaacgattttaccttgcaagctatgcatcaacaatttgaaaggttgaatttgcaactccaagaaataagggataccattgccgatcaaaatgatacaatagctgaacttaggagggaaaataatgttaggccccaagctaggagaaatgtaccccatgctcccattgtaaatcaagaaaattttataaatgattttaatgatattgattttgatagggtgggaagagataggaggggacaaagaggtagagtagaagatgataatataagtagtataaagatgaagatgccatctttcaagggaacaagggatccagacttgtatcttgattgggagaggatggttgaagccatctctgactgtcacaactactctgaaggtaagaaggttaaacttgttgttgtttagttttctgactatgttgctatttggtggaaaaagcatactagggatagattgcaagaaggagaagcaccagttgctatttggaccgaggtgaagagggtgatgaggaagagattcgtgccatcacactttcaaagagagctacaaaaatgcattcaaacactgaagcaagggtccatacccgtggatgagtactttaaggccatggatatagctatgatccaagctaattgtacagaggaagaagaggctacaatggataggtttttaaatggtttaaataaggaaatatccgatgtagtagaattacaacaatatgtaaaatagatgagttagttgatttgtgtgtaaaagtagaaaatcaaaataaaagaaagcagactagcttgtggaaaggtcgacaggcaccaactccaagaagccatggaaaaatcatgagatgaaaagttcttctaggcctctagaagacaagggtaaaggtaaatttgagaataaagagggaggtaaaacctttaaccctaaaccttttacaccttctagttctattcaatgtcataaatgtaaaggaaggggacatatgatgtatgaatgtccaagtagaagaaacatcattcttagagaagatggaggatatgagagtgaaaaaagtgagggagaagaagagggagatgtgagtgatgaagatgatgttgaactacctaatgatggaatggttggggtagttagaaggattatgactatcaatttgggaagcaatagtgaagcacaaagagagaatatattacatactaggtgcgggataaagggaaaaacttgttctatgatcattgatagtggtagttgtgctaatgtggtgagttcatactttgtggaaaaacttggacttgcatgcatgaaacaccctactccctatagactccaatggttaaatgatagtggtgaactaaaggtaaacaaataatgtatgatttcatttaatgttggtcgatatgaggatgatattctttgtgacatagtacctatgcaagcttgtcatatattactgggtcgtccttggcagtatgccatgaatgtttttcatgatggaagaaagaatagatattctcttgaactaaatggcaggaaatttactcttgcacttttatctccttctcaagtatttgaagatcaaaagagattaagggaaacaatgggaaaaccaaggggagggataaaaagtaagcttgaggaaaaagaaaagaaaggtggccaagaattataaaaatatagagatggccgagagaaagagtagcaatttgagagaagagataaaaatggagttgagtgaaaaaaaagaagatcttagtgagtggaaagaggctaaggaaagaaaaaaagagagtttctatataaaagccaaagagtgtttaaatgcaacaaaagaggggttgcccgtaatactacgtacttacaaagaagctttgattaattatgagttactaacttcttctttgccaagtagtatatcttctcttttgcaggactttgaagatgtctttcctgaagatattcctaatggattgccacctttacgtggcattgagcatcaaattgattttgtgcctggatcagaaatcccaaataggcctgcttataggagtaatccagaagagacaaaagagcttcaaagacaagttgaggagttgcttgtgaaaggctttgtgagagagagcatgagcccttgctctgttcccgtcctattggtacccaaaaaggatggaacttggaggatgtgcgtggattgtagagcaatcaacaagataacggtaaagtatagccatcctattcctcgtcttgatgaaatgttggatcaattacattgatccaaaatcttttccaaataattgatctaaaaagtggttaccatcatattcgaatgaatcctggagatgaatggaacactacttttaagaccaaatatgggcttcatgagtgcttagttatgccttttggcttgactaatgcacctagaactttcatgagattaatgaatcatatctttaaggattttcttgggaaatttgttgtggtgtactttgatgatatcttgatcttttctaacactttacaggagcatgtagaacacctaaaacaagtttttgaagttcttagaaaacaacttttatttgttaattttaaaaagtgtactttttgtgtggatcgtgtgattttcttgggttttgtagttagttctaaaggagttgaggttgatgaagagaaaatcaaagcaataaaggaatggcctaaacccaagagtgtaaccgaagttaggagtttccgtggactttgtagtttttacaggaggtttgtgagagactttagcaccattgcttctcctttaacttaagttattaaaaaggataagatttctaaatgggtaaaagaaaaagatgatgcttttaacttgttgaaagaaaagttatgttctgctccgttgttacaattgcctgatttttctaaatcttttgaaattgaatgcgatacttctggcaaaggaataggtgctgttttgatgcaagattctaaaactattgcctaatttagtgagaagttgagtggagccacattgaactattccacttatgataaagagctatatgctttggtaagggctttagccacatggcaacattacttgtggccaagagagtttgtgattaagacggaccatgaatctttaaaatacttaaagagtcaaggtaaggttagtaaaaggcatgctaagtgggttgaattcattgaaactttcccttatgtaatttcttacaaacaagggaaagaaattttttgttgctaatgcactttcaagaaggtatgtcttagtttctaccctgacttctaaattgatgggttttgatcaaatcaagggtctttatgctaatgatgttgattttggcaaaatttttgcagattgtaagttgagtccttttgagaggtttaacctccaagatgggtttctgtttaaggaaaataagttgtgtatccctaattgctctttatgtgaagtatttgtaagggaagcacattgtggaggccttatggggaactttggagttccaaagacattagacatacttgctgaaaatttcttttggcctggaatgagaaaagatgtagaaagaatgtgcacacaatgtttgaaatgtaaacaagctaaatctaaagtgttaccacatagtctttacacgccattacctgttcctacttcacattggattgatatttcaatggattttgtgttagggttgcctagaacaaggtatggtaaggatagtatatttgttgtggtagataggttctccaaaatggctaatttattccttgtttaaagactaatgatgcttcacatgttgctaatctttttgtaaaagaggttgtaaaattgcatggtatacctagaactattgttagtgatagggatgctaagttattgagccacttttggcgtgtattttgggggaagttaggaactaaattgttgttttctacttcttgtcagccacaagctgatggacaaactgaagtggttaatagaaccttaggaaacatgttgagggctcttttgaatggtaaattaacttcatgggaagatcacttacctgtgattgaatttgcttacaatagaacaatccattcttctataggtatgtctccttttgaggttgtttatggctttaatccctttactccacttgatttattaccattaccaactaatgatattgctaatcttgatggtagaacaaaggctgagatgatgaaaacaattcatgagcaaacaaggcttacaattgagaagaaaaatgagcaaactgccttgagaaagaataagggtcgaaaacaagttatttttaaacctggagatttagtttgggttcactttagaaaggagagatttccatccaaaaggaagtcaaagctgcatcctagaggagatggcccctttcaagtccttgaaaggattggagacaatgcttacaagctggaccttcctggtgagtttcaagtaagtgctacattcaatgttgctaacttatatttgtttgatgtaggatcgaattcggggatgaattcttttcaagaaggggggaatgatagcatcaatgacaaggatataattaaagacaatgatagagttttggaagctccaaggccatttactagatcacaagctaaagagttgcaaactaaggtttgctggacttcaatggcaaataaagaagcttttaattgtagaggaagaactcatgcccaaaggagatgaattatccaagttttacaattatttggtggtccaaattgaagtccaagatgaggaagattgtaccaccaaattagccattcaagtccaccaaaagggctcaaaatgaccttacaagaggtccaaaaaggggtgtttcaaaaagagtccaattggagtccaaataaatggcccaaactagtagtttgaaggcccaaatcttccccaagcgtatttggccgcccccctccgcccacctaattttgatggcttttgttaccccttaggagccacctacctaagtttgatggctattgtgacccctagcagcccctacctaattagatgactttttagcaaccccttacattattttaagtgtttttactcctataaataaggggttcttctcattcataagagacaacatttttgattaagtatatcatcctttgagagttcttttgaacctttgttacttgtgctttgagatttatctttcaacctttactagttcatagttcaaggtagtaagatttcatctcttttatgatatctttgattcctttgtggtattcttagaaggcgattaatactagttattaattgttgtctcaagttactcgtaaagcgatcaagatccgaatctattgttttgatttgcttttaagtaaagtcatttgatttcttccataaatcaagacgttgctactttgatcttgtcttgcgttcttggaatttcttgaaattctttccttgaattttcccatatcctttattttcatctctttaattctagttgttcaattccttgttgttattgcttccacatttacttctcaaatacttactctagtttggatttccgaccttgttgttatcaattaatatatatatatatatatatatatatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtgtgtgtgttgcccgagttaagcccgagcccgatatattggttcatgaaattgtttaaccaaaaatctgagtctttggtcaaagctagaaataaagagaaattcgggttactaataatcaggagatgaaaataatagaagacttttgaggaaaataataaagcaataagtagttttgtatttcagtgtaatctcaatgatatttcgtgtctacagatgttgagtctttctccttttatagttgattctaggagaatgtgtaatgtctttgtcttaatgaggcaattatgagcaataaatgacattaaagaaaattttacacaatcattcctatttaatataaattctctaacgtatttgatatttaatgctgaatttagactcttttacgtcatcagattcgtatcttcaaccccttccaatcttcgattttttaatgactcgaataggtacgatactcatgccatttgaatagcgactcgtacctatgttgctttcttctccccgtatctatagtcgcccgtgcctgttggctagttattgtgttttgaccttttgaccagtccacgtgtcatgacacgttatcttcaatatacagactcagttttttcccaatacagatagtccccccacttttcatttatttatcagttaaatatttgtgaagtggatcttcataaaaaaagggaatttttgccgtaatcaatgctatgacagtactgacgcttcagttgtcttttctatttaatgctctacacacatgtctccttctgatttgctctgtaattctgcagccttttttcaaggcttcttcatcccttctattcacggagtgatagttgcctttattataggctttctgtcattacacatcttagtttgacggttgctattatacacatatcttagccctttttttcattgtcttcttcttcacaaacccttaacagatactttactcttttcttttattctcttctcctttagttcatcctttctttgcaatgtcgtcttcaaaccctaaccctaaaagagtcccaattcttgaaagcttccccaatgcccctataagacatagaaggggtagaggaggcaggcctcgtagcctaggatccgctcgcggtggttcctctggttccatcactccttcttctagttctggcactattctaaaggttctatcactaagaaatcctcttctaaaggtaaagaaccttctgaacctcttcaagaacctttagttgaggaaatagtaccaaatgacttatcttttgggaatgatagaaaatctcttcatgaataggttattaatttagagaaagctgacacttttccttctctaattactgaacctttgattcctattgttcgaaaggattgtcgctggagaaattatcttcgtataatgatccctaatccaaaccagagattttcttctttcaggattggaatttcttttgtttatacttatcccttcactttgggatttactcatgctatcgacccagttatatttgatttttgtcgttttatcaaaatttgtttagtacaagtcggccctcttgtataaagagcagtggcttgtttacgatatttatccgtcaaagccaatgttaactttacctttccctatcttattcatctctacccctcaagctattcctccatggggtttttactttaactacaagaagtaaaaaggtcttggtaagccctgaagatgacaaggatcgtgggtggtacactcgttatgttgttgtacgcacagttgatttggtgggtgaaacaaatatccccttccttgagaagtggaacttttcacgtaagttttttttacttaccgtacccatctttaagaatttcaatttcttttctaatttcatctccttttgcttttctgtagcaaccatgggagatgtggaacctgttcctaatttccgtggttgggtagattcaatcttgaaagccgtgcctatggaggcgagaacctggaaatccatctctcttttacatggttggaaagtgaaaactcacggtatgcatatctttttgcttttccatatgttaagtcccttcttgtttctaactttttatccttctttttgtcaggatttgctattcgaggaatgaaagccgaagtagctattgccctttgagcctcttctggaactcccctctctttggaaagaactcaagctatgctgtcaaaaatttaaattgtggaagaagattctgaggatgatgaagatgaagatacctctttgatacctaggccaagagccaggagacgcatcatttcttaggatgaagttgaggttcctcctgcccgtgcctctctcaccgaacctgttcacattctttctgatgatgaaaccactccaaggaacaccaatgggtctattcaacgtctctttgttggtggttttgaatgtggagaacttggtccggttctaaatgaagttcctctttcttcctctattcccattccttctattcctctcttagttacaagtgtttctttgcccattttatctactcctgcttccttacctgtttcgggtcccttatctatttctactatcccagccttgactccttcaactcctgttattttcacttcttccaccgctcctccttatatatctcccccttcctcagttcaacgtacaaatgagggttccagtagtagaagtttggctgtgaggagcgtgacacttgaagttccggctaataacagtcttttaagaaagtctggtagatctgatgtctggcttgggcgtctaattggagatattgaaaagaataagatgaaaatccacaactacttaactctgatgaatgacatagttcattctactttgaaggtagtttttcttaacttacaagtttttttatctctagattctcactttcatgccttaccattgtaggctaatcttattgtcactgaattgatgggaagaatctccactttagagaagaaggctcgtgaatctaaaaagtctatccacgaggctgaggaaatagccaagggagcccagctagaagcagctaactggaaagagcagttcgagaatgcttagagaactatagaagaattgcaggagagtaaaaatcacctagagcagcaaaagcgaggtttgacttctgaattagcagttgccaaggcttattcaagccaatttgaaaaagataaggagcgccttgaatgttactatttagaacaattatcaaagtcaagtaaagaaatcaaagaacttaaggcactcttggacaagaaagaagaatatgcaggagaattagtacaaaacttgactcaagttcaagatgatttaaggatctcctcaaacaaggttcgtgccttatagagttctcatgcctccctcgaagcttcccttgattcccatttagctgaacaccaagtcttgaagaatgatcttgctatatgggaaagggagtatgaacttcttgaggagaagttttatttagaagtgagttgggctttcttaaattctcgtcgtgatgctttaatggaggccagtcaagaaaactttgacttaaactcagagttggccaaagttgtaacgaatcgaccgatcattttgagaaattaagatccgtttagtgacataaggtttgtaacagctttggaatctgaatatcgacttgcgtgcatggtggaattcggctctcagatggtttagaatcaaattcagagaaggaaccttattttggaagtttgaacggtgaaaagttgactggaatcagacttttgggtaaacgaccccagaatgggtcgtggatgatctcaacagcttcgtatggtattttggacttaggcacgcatccggattcagatttggaggtccatagaataaattgaggcatttcggcgaaagttgaagttggaaaatgaagaagtttgacccacagttgacttttgagatatgggggtcagaaagcgattccgagagttggaacagctctgttatgttattttggacttgtttgcaaaatttggcgtcattccgagttgaatttataggtttcggcatgagattcgttatttgaagatttggaatttcataagcttgatttttggtttgattcgtcgtttctatgttgttttatgtgatttagaacttttatcgagtccattttaggttatatgacttgtgtgtgtgattagatggggtcccgggagcctcgggtgagtttcagataggtttaggctatgttgcgcttgtttttgaatgctttgtcgtcgtttcttcaagcataaatgataccacattgagcaaatgagatccaaattccattttgtttgaactactatatccttatcaaaattacggagccataggaaaaagaatcatcaaaattggacatcgtatgaggaagttatgctcattttcgtgttggggaaattgctggtttctagtgagttcgcaaatgtgaactttttcatcgcatttgcgatgcccaattcgcaaatgcgaacttattgtcacaaatgcgacttctaccagccctttttttttttgcaatttttgcgaaccctgggtcgcaaatgcgacaactgagacctgttaagtgaagtttttgacgggattttcacccatttttcaatttcctcaaaccctaatcttccataggtgatttttcaaagacccaaacttctccaaatcattgggtaagtgtctttaatccatttccaactatattttgcgtttatatcttagatttaacatcaaattcatgagaatctaaaggaaaatttgggtaaaattgtgaaatctttcaaaaatgtaaaatgatgatttgaatgaccaaatggtatcgtaattagataatttttgtatgggtgaactcgtaacggaatgggtgttcggttttttgtaaattttgtcgagtttcgaggtacgggcctagggaattgagttatgttgactttttacaaattgtataagaatcatagttttgtcaattgaaattgttttctcttgcattgtttgatgtattcaagttgtttttggctagattgagctgagcattgatgaattggtaaaggaaaagctaaattgagtattgaataggccggattgaggtaagtatcttgcctaaccttgtgtgggggacttccccttaggatttgagtattctctgttaattgtatttcatgtacgcgaggtgacgagtgcgtgctcggatttatttgtggtaaattgtctcttttaggctcttagacccttgtaatcaacaagtatgaagatgatattgatacaattgagttccctgttattagtttcacttctacatgtcttacttggtatttacttgctcttcttggtttattcctgctgcttagtctacttctacttgtttaactgaaaacgtttaccctattatagccacgttatctctccaaactgcttgtctctaattgaaaatcattatccttacttctcatgaaattaattggccttaattgaaaagaagttagatatcctatgtttagttgataattccctaattgtaattatttgtttcatgttaaattccttattgttggatactccttgattgtaagttcatctgtgactacgtgcaaatacgttacacgtccaactgttgttgttaccggtgtagctatcacgcatttattatgtcttgatattcttgttgatgttatcgtgcttattggtttttccgtgatccttcttatgtattgttgattcccttgccggaacgttattgtttcattgttggttcctgtcatgactcggatttcccaccctcgggagtcgtaatggcgcctactgtggtagctaggcaagccaactataacatgcttttaacaatttctattcaacaacactaataatgaaatagtaaattaaagcggaagtcttaattaattaataatcgaacaacaatacgggaaacctaacaacatcctctacctaagatttagtgtcataatgctcacggactactatgaaatactaaaacaaaggtctgaaagaaatacatagaagagtctgtctcgatataagggaaacaaactaataatatagaagggactccggcccgcggatgcctgctagagtacctcgaaaatccctggactgaagtcggcgcacgagcaaatacaactactgaggtccaacggctgctcctggatctgtgcaaaaagatgcacagagtgtagtatcagaacaaccgaccccatgtgctggtaagtgcctggcctaaccctggggaggtagtgacgaggctatacaggacctaccacaattaacctgtacaaatatacatataccggtgaaaggagaaataacaagagaatacaagaaaagctgggagggggacatgctatcggggagtaataggtgaaagtggattatcagaattaacaaataatgagatggaacgtaataataacatcagctaaggagaacatgtaaacaagcaactgcacggcaccaaccatcgtgctttaactctcgttcaccacaaaacaatcaaataaagtaaatcgatggctatacggcatcaaccattgtgctttgtcactcttccttttcccaagcgataatgtaaagtaaatcattaattacacggcatcatccatcgtgctttatcgctcatcctcacccaagcaacaatcacaacaatggggcgagagaataaacaagtaatagctgaaatcccgcaagggaacacaattaaacaattaaaccccagcaagggaacacaagtaaacaattaggtcctggcaagggaacaatttagtaattctttctctttctttcactttcatttcataactcactttaccacttgagccaattttcacgtccttagtcttaaactaagtacacgtgcgacacttgacaacttgctcacaatcttgcaaaccttgctcacgttcttgctatgccaagtcatccctactacactcaagatcgctaagagaatggaagaaagaacacaagagaattgctaaaggaagctttgtattagagaaaacttgaattgtttgattggttgatgaattacaaatgaatgcccctatttatactaatcacctaggggctagtatgtaaataataattattctacaagtccttccatatatacaactaagtcccttctctagaattttctacacaactagattcttctaaggactttcctaacaattctataaggttctagggtcttcctaaagaaacctctatatttctctagaagcttcctacaaatgcataaatatctagaacatttccaaggaaattctcaatagttctaaaatattccaccaagatctagtcctaaacttatgtaaccatcccatatggcaaaaatatatgccaagtggcacctacgtggcatgatgatgtggcgggtcatgacactctcccccacccaattttgtgccgacttggcacaaagcattgacacgtatgcgcgcaccttgcgttggcgtcgccggagatctttgtccattacccatgattccctatgaagcggtttgccttcccatttcacaaggtactgctcacctctcttcttatgtggtttgtacattggacgactagcaataaaggcctccatccttcgcccatcggatgcccttccttgctattggactgaatcttcccatggctcaaccaagtctagcagcttctcaagtatcgagtccatgcttctactccctatttggctgccctctgtggtccagccttactggcaaacttgaaccctctgcttggtgcatcgtctgagtctgatttcatgccatcattttgtactcaccatcctcttcaactatgtcacccttatatgcttgagcaaatttcccggtcattgctacaagcttccccaactctgggcattcacttgccccgatgtgaccctttgtagatgtatcaccctcccttaggcacgtactccctaccatttttccggccccttgccgtttctcttggacccctgtccattatggaatggccccttgccattacccttgtatacctcggctatgcatttctcgttgtcctcatcatgatctccatcatccctctcggtgttgccttctttggacttagtagactccatctcgaagtcaaccagtgactaagctactccgatggacccgttcatgttgactactagatatcttcttaacttccgcttcgcccaattttgcaacccatccatgaagtagaagaggaaatcttcctcggacaatgacgagatttgcagtattaaggtagtgaactcgcgcacatactcccgagttgtggccgtctgtcggagctcctttagcttccgcctacccttatacaccacattcatcgagtagaactactctttaactccttcttgaactgcactcacgtctcaatcttgcatatccattttccatattggcacactttcgacgccaccgcagcacgacaacctcggtcaagtacattgaggcgttgcgtaccttaacaacgtcgtcgtcctccttgactatatcaaagtacttgtccatcctccaaagtaagtctgctgcctcgcgtacgtcccgtgtaccgccatacgttttcgattagggaatttcacgttgatcccttctgcaagtaccaagcccttggtaattccggccatagttccctacaaaatttccctctagcaatctcttgtattctctctaacattccttagtcataacctttgctctgataccacgttgtcacgtccttagtcttaaactaagtacacgtgcggcacttgacaacttgctcacgatcttgcacaacttgctcacgttcttgctatgccaagtcaaccctattatactcaagatcgctaagagaatggaagaaagaacacaagagaattgctaaaggaagctttgtattagagaaaacttgaattgtttgcttggttgatgaattacaaatgaatgcccctatttatactaatcacctaggggctagtatgtaaataataattgttctacaagtccttccatatttataactaagtcccttctctagaatattctacacaactagattcttctaaggactttcctaacaattctataaggttctagggtcttcctaaggaaacctctatatttctctagaaccttcctacaaatgcataaatatctagaacatttccaaggaaattctcaatagttctagaatattccaccaagatctagtcccaaacttatgtaaccatcccatatggcaaaaatatatgccaagtggcacctacatggcatgatgatgtggcggctcatgacacaatgctccaaagggcacaatcaactcataaactttcacagttcgttttataactcgagccaacgctctaagggttcaatcaacccacttactttcacaatttcataatataacttgagccagtgctccaaagtgttcaagtaccacaattacttcaccaactttcctcaacaagtagaaatcatctttagagaatagattcttcaacacaatcataaaactcatatcatattactcgaattaaacaatttaagactcacggtcatgctagactcgggtgcacatataactgtcaccatgcctatacaccgactccacaattagcacatagcaaataatatcctaatcctattccctcaagccaaagttagatcaaacacttacctcgatctgaaaatagcaatcaagcctctaacaccgccttacctctagaatccgactcccaaacaacgatatctaggcataattaggttcaatattatcaataagggtccaaaaacatcatctcatagcttagaaatgcatttcctaactttcttccaaaaataccaaaattcgatcccgagcccacatggtccaaactcgaggctcggactaaaacccaatcccccataatcgcacgagttcaaatatgcaattagttttaagattcgacctcaaattgaggttgaatcgcccaaaatcccaagaaccctagttctacccaaatcccctaatttctaccttgattttatgttttagggctaggaaattattgattagatgaggaaatagtgaggaaatgaagttaggattacttacccaaagagttgtgaagaaggtagaacttgaatttcatcaatggaggattttaggagagagctcgtgtgaaaaatggtagaaatcccgagcacactgattctgtttttaacttaaaataccggacgaaaatttctctataagatcgcataagaaggagtgcgatcacatagagtggggatggtgagactttgcgatcgcgaaggtccaatgctttctcatagaggaagtttttttgggtttctgaggaaaacactatgcgttcgcggaggatctatacgaacgcatagaagaaactggggggggggggggggggggggggggtctggtttgcactatgcgaacgcgggaggggaatgcgttcgcatacaagaaaactctgggcttgacatttgcactatgcgaacgcggatgagtaatgcgttcgcatagaagaaatcttgcctgcaacagagatgaaaaatctgctgcattttccaagttcaaaataccccgaaccatcctcaaaaacactctcgagccctcggggctcccaaccaaacacacacacactaagtaattaacatcctacgaacttagtcgagcgatcaaatagccaaaataacatcaaaattaatgaattaaacctcaaattcttcattttcccattttaacttcaaaacctctaactttagattcttaggtccgaaacacgtcaaacgacgtccaatttcaaccaaacttcacagataatggttaaaccacatatgtgacctgtaccgggcatcgataccaaaatacgagcccgataccattactttttgatcaaatttcattttcattttccttaaacattttcagaaaacaatttcacggaaaaattctttcctcgggcttgggacctcgaatttcgactccgggaatactcccgagtcccatatatttctacggaccctccggaatcgtcggatcacgggtcctggtccgtttacccataatgttgaccatagtcaaccatatcaatattataatcaattttcatagtttttgacacacaattcatatcctttcacataaaaactttccggctttgcgcttggtctgtgcacgtaaatcgaggcaaccaattaagaggttttcaaggcctcagaagcacggaacaggggagaattatggtgatgaccctttgggtcgtcacgatctcctcttctaaaacaaccgttcgtcctcgaacggacacaagaaagaagtacctgagtcgggaaacaaatgagaataacggctccgcatatcagactcggactcccaggtcgatgcctcaggaggctgacccctccactgaacacgcaccgaaaggaaactcttcgacctcaactgtcgaacctgtcggtctaaaatagccaccgactcctcctcatatgacagatccttgtccaattggacaatgctgaaatctaacacgtacgatggatcgccgtgatacttccagagcatagacacaagaaatactgatgcacaactaataagctaggtggcaaggcaagtctataagccacctctcccacacgctcaagaatctcaaatggtctgataaacctagggctaagcttgcccttcttcccaaatatcatcacgcccttcataggcgatacacagagcaatacccgctcaccaaccatgaaagcaaaatctctgaccttgcggtctgcataactcttctgcctggactgagctgtacggagtctatcctgaataatcaggaccttatccaaggcctcctgaaccatatccgtgcccaataactgagcctctcccggctcaaaccatccgattggagaccgacaccgcctaccatacaatgcctcatacggagccatctgaatgctggactggtagttgttgttgtaggcaaactctgctaaatgcagaaactggtcccacgagcctccaaaatcaatgacagtggctcggatcatatcctcaagaatatgaatagtcctctcggactgaccgtccgtctggggatgaaatgttgtactctgctgaacctgggtgcccaactccccctgcaatgctctccagaaatgcaaagtaaactgcggacctcggtctgatatgatagatatgggcaccccatgaaggtgaacgatctccctgatataaatctcagctaacctctgggatgaataagtcgatgccacaagaatgaaatgtgctgacttggtcagcctataaacaataacccaaattgcatcaaacttcttccgagtcatcggaaggctagtaacaaaatccatggtaatcctctcccactttcactcgggaagttcaatccgctgaaataacccaccgggcctctgatgctcacacttaacctactgacagttcaaacaccgagcaacatattctactatatccttcttcatcctacgccaccaatagttctacttcaaatcctgatacatctttgcggcgcccgggtgaatagaataccgagaactatgggcctccgctaagatcaactctcgaataccatcgacatcgggcacacaaactcgtccctcaatctcaatacaccgtcattccccaaagtcactttctgggcaccttcgtgctgcaacgtgtctctcaagacatataaatgtggatcctcaaactgctgctcatgaacacggtccaataatgaagatcgagagaccgtgcaagctaatactctgctgggcttagaaatatccaacctcacaagacggttggtcaaggcctgaacatctaaggcaagcgatctttgactgactgtaatataagaaatattactcatgctggcagacttcctactcaatgcatcggccaccacattggcctttcccgggtgatagaggataatgacatcctaatccttcagcaactctaaccacctcctctgcctcatatttaactttctgcttgaacagatactgaagactcttgtgatcagtataaacctcctatgtccaaatcttcaaggcatgaacaatggttgccaactcaagatcatgaactggataatttttctcatggatcttcaactgtttcgaagcataggcaatgactttgccctcctgcatcaatactgcaccgagcccaatacgggaagcatcacaatagagcgtgtatagccctgaacttatgggtaacactaataccagtgctgtggtcaatgctatcttgagcttctgaaatctcgcctcacactcgtctgaccacctgaactgggcacccttctgggtcaatctggtcataagggatgcaatggatgaaaacccctccacgaaccgtctgtagtaacctgctaaccccaagaagcttcgaatctctgtagttgaagctggtcgaggctagttcttaactgcctctatctttttcgggtctacctgaatacctgcttctaatacgacatgacccaagaatgcgaccgaactcaaccaaaactcacactttgagaacttagcatacaactgactatcctttagagtctgaagaaccactccgaggtgttgctcatgctcctcttaactgcgggagtataaaagaatatcgtcaataaagacaatcacaaacaagtccagatctggcctgaatactcggttcatcaactccatgaatgccgttggggcattagtcaatccgaacgacatgacaaaaaaaactcatagtgcccataccgagtacgaaatgctgtcttagggacatcagacgcccaaatccccagctgatgatagccagatctcaaatctatctttgaaaataccttcgaaccctgaagctggtaaaaaaaataatcgatcctcggcggcgagtacttgttcttaatcgttaccttgttcaactgccggtaatcaatgcacattctcatagaaccatccttcttctttacaaatagcactggtgcgccccaaggagaaacactaggtccaatgacaccctcctcaagcaaatcctgaagctgatcctttaattctttcaactctggcggtgccatgcgatatggcagaatagaggtgggctgagtgcccggcgccagatctatacagaaatcaatatccctgtcggacggcatgcccaacaggtcagaagggaagaccttaggtaaatcccgaacaataggaacataatcaacagacgggacctcagcactagagtcgcggacatacgctagataagctagacaccccttctcgaccatgcgtcgagctttcacataagagataacgcggcgagtggtatgacctggggtccctctccactctaatcggggcatatctggcaacgccaaggttacagtcttggcatggcagtccaagatcgcatgatacgggaacaaccaatccatccctaatatgacatcaaagtctaccttatccaatagtaacaagtcgacacgggtctcaagacccatgaataccacagcacaagaacggtgaacctgatccaccactataaaatcacccacgggcgtagacacatatacaggaatacccaaagcctcattaggcataaccatatagggtgcaaaatatgacgacacataggaatatgtagatctaggatcaaatagcaaggatcaaatagcacagaagcatctctatcacaaatcagaacggtacatgtaatgtctgcacttgaagtctcaacctttaaactggctgttggctgatccctactgccggcggtcttgactctacctctaagacctctacccccgcctctagccggctgggtaggctgtggaaccctcggtgcccgaagctaagcacgataactctgatattgggggcagctcagagctctagggaaaaatctgacaatgtgcctcggatcaccacaagcatggcaaagcctcatccactgctgccgagcacccctcaacctcggacaaaccctcttgttgtgaccatactcaccatgctcataatacctacacacacactgtaactgagaaaattgaggctggccctatcgacctgaattatcacttgaagtaccatgagtgacatggggagataactaaaagggcctgaaaagatggcctctaccataaaaatcacgacctccagacgaggtaccactgaacctgcctgcacgatggggcctcttatccgatccacgaccacctcctcgtggtagaaccatctcaactctacggcccacattggtcgcctcctgaaaagggatctcactccctgcctgggccactgcactcggctatcctgccaccgctggttgagaccctagaagcaaacccgcttgaataacaccctccatgagatccactaatatgactagagcgtcctgaagaactggggtggctatgaaccccacagggacttgagctgggcccactggagcggctggagctgggacttcctcatcgaaatcaacatggggctccacctctggaactgccgcccgtggctcggactactgagcggtggatgaagaagcgcatgatctcgccatctgtaagagaatagagtagaaattcaacctgtgttcaagaaacggaaacacacgacaaggaagaaccaaagtgaaagtttcctaactctatagccgctggcgataaatacagacttttccgtaccaatccctctgactctaccgagtttgtccgtgagttgtgagacctaactaacctagtgctctcttaccaacttgtcacgacccggatttcccaccctcgggagtcgtgatagcgcctgctgtggtatctaggcaagccaactaaaacatgcttttaacaatttctattcgacaataataataatgaaacagtaaattaaagcggaagtcttaattaattaataatcgaacaacaatacgggaaacttaacaacatcctctacccacgatttagtgtcacaatactcacggactactatgaaatactaaaacaaaggtctaaaagaaatacatagaagagtctgtctcgatacaagggaaacaaactaataatatagaagggactccggcccgcggacgcctgctagactacctcgaaaatccctggactgaagtcggcgtacgagaaaatacagctactgaggtccaacggctgctcctggatctgtgcaaatagatgcacagagtgtagtatcagcagaatcaaccccatgtgctggtaagtgcctggcctaaccccggcgaggtagtgacgaggctagacatgacctaccacaattaacctgtatatgtgacgacccgacccatcgtctcttgtatctccatcccgttatccccgttatatgtttccccgtgtgttgacatgcgtgtttggtgaggttgaagtggttcgggttgaaattggatagaaatgagataaatagtctttttaagaaaagcttaagttggaaaaaaagtcaacccaatgttgacttatgagttagagggctcggaatggattttcgatggttcgactagtttcgggggatgattcatgacttaggagtgaaaacggaagtgaattcggaggtccggtgtgaaagttagcttagattggcgaagtttgaatttcggagaaatccggttgataggtgagattttgatccgagagtcggcaccgtggattgtgatgaaaacggtggtaactattggcaccgtggattataatgaacagtggtaactattaacactgtatgatatagcgcttgggctgtaggagcccctccggagtctgaacccccacagtgagcgcgggtacccatatggatggctcggactgcacgccgcagtggacatgcattgctttgcattcatgcatctattttctggcattttacctggttaattctgtatgatgtactgtatagaaatgttaaatgtagctttgttgtgtgcgtattgtggatttccttccgtcaggttttatatccatttattacttgctgagttggtagactcaccctatactccctgcaccttgtgtgcagatccaggtgtcccggaggcatagtgagctgctgttgccgatatcagatcgtagcagagatttgaggtagctgccagcatccgcaggacccactttttcgatcttttgatttcctttcagtcttcagacattgtactttctttttgtcagatttgtatactatattcggtagaggctcagtactcgtgaccattgattttggggtattttgtttagattctagttctgctattcgtatcgttttggtccctgattggggaagttacggattcatatttgtccctttatggactgggaatctctttcttgggtatgtttggtcgggcttgcctagccttgcggctgggcgccatcgctatcgggatttgggtcgtgacaacttggtatcagagcctaggttactaggccttacgagttatgagccggtttagtagagtctcgaggatcggtacgtagacgtccgtatcagaccctcgagaggctgcagaaccttaggaatatgcgcccgtgagcgcccagtattatatgtgccttgatggctggtggttctccgatcgtgaggcgaattatgattcctatgagttgatgttgggccagtctggaggacttgaggctgaatctatgtctatggcttgagcactaaggtgcttattgcgcgagctagtgttatgagtttaaggttcagtattgtctttaattgtggtctcggcggctggatggcttcatgatgagtacgttgttgctgtgtggtatgtctgtatgacttggtagtgtcgatgtagggctgctaggtgttaaataaaccattaagtgtttgatttccattgcgatcggatgtgttgccccgggttatgggcgcgtgaggaatcttttcgagtctcctaggtaggagtgtgcgtgttgtggtatgagtccatactcaggaagatcaattgattgcgtgaggagtatggcggtggatgatgtaccgaaatattatattggagcaagcatgtgggtatctcctgcagattattctgaaatggtatgatcattatgtgtatgttagaagatcttatgtgtaattaaaaagtattttctatatgttatgattcgaacaggtgcaacgcatgttcatgtggcaattatggtagcataatacatgtagcattgggatttctgttattgatatacaatgtgatatcttgtcaagttgtggacgtattgttagactggttttggtggttctttgacaggtggataggctcaattacaaaggaatttctgccaaaattttaggaaaatttgagacttagtagaaattttgtcgcctaaagagtgggcttaacggttgtgtgaatgtatgcaaaaattggagagaagttaaaaattctgatgattcgtgttcccacaagcttatgaaagagtgagtttaatctcgccatgattatgatggctatagagtatgtgtgtttcaatatatatatggcttcgagctaagttggggaggtcgctgtcgatgagctggtggtgcggttatgtactgtgttagttccgatttgatgcaagtgagagaatcagttctagttgcaggaagtgagctgagggtggcacgggcgaagcaaaattttgccaaaggttatatggtgctttgtagatgtgagaaaataagggaatgtattgagttgtggataaagaatgcttaatgtaaagaggaggcattgttggattgtatcggaatgggaacacgttctgtggtgtcagggtgctaataaggcacgagtggttcggttcattaagtcaagtgatctgcggtgtgtataagagtggatgacttttgagaatggttttgatgcgttcaagattctatgtgtatcacgcatgtgttctaagggtgagtatgtgactaagtcagtatttcattagaacaggtcaagactcgtggtattgtcatgttaattacaagattctatgtatcagtgtttggaaagtgatggtaactaattcactgtcgcaggaagttcttcgggtaaagtattttgtaatgtggtgtttctgagaacggttaagatagtattttcgtggcctatgggtcttagacagtgcagtctggtgttgagtttcgtatagtgagccagggttgaggcattgtggtgctacaacgagagagtatatcaagttgataatgaatcaggtgggaatctagacaaatgaagtagcttgttagtggactgaatcggcatggtaaagataggatcaatcgtttgtatgtgttcgaggtaataggttcttacaagcgtatggtagtgaagctcctgtgtactggaagtctgcttagcttggttcagatagagggattccgttcttggcagtttaatttgtgtaaatggaattgggagaggattcttgttgaagtttcatcgtggtttggggttgtatattttctacggaaatgcggagcatggagtgtataataaaatcttcttctaaatgggatcaatggaagtcttggactagttgagtgcgtcgatatttgcggcgcagaagggagatgaaagttctcgtgttatccttggaggatattgtgtatgcggtatgttggtggatttggctatgtcttaggtaaggagtagcttcaggcaatcaaggaatttgtacgggtaattggaagtgatttggcaatagcatatgtttcggaaagagggtagttccacaaatggtacatcaatagtgttacagtattttcttatggtattgactgcggagatctgagttgttttgatggcacatgggagttttagaatatctttcgtggagtaattgggtacttggggtgtaatctgtatttcgcattgtggaaatttggatcaggcacagtgattcatgtgctatgagtagttggagactgggagttctccggggcagtctatgcggtgattgtggatcgtgtatgttgtattgatatggttagcggctattgggagattggaatctgagtggatccttccttgctttgtatattaaatgctggatatgttatgtggatgtagagcggctgccttagtgtcggatggttctaaacgattgtgctatgagtcatgttgggaattgccacaggttgcatgtcggggtgtatcagactatgttctagctggatggttatgttccagagactagcggtcgactgggaagaattgcgtttcataaattaggccttcgaggcagatgtcagtatagaggtttctaccattgatttcggttccagtattgagggacttttcatatgcatccttgtggccgggcatgtcgccgggcgagactgtggatttcagtaatcatttggtgccgggaaccatatcgtacggctccagtatgagttatagtagtggaagtggaattttgtagcttacaacgcttgtatgaatatctttatgcactcagttgcttacgatcgatgttggtatcttgttattataagcaaatctagctcgatgtgcacctccctatgtaaggtatgttgtgtggatcgggtggcacgccgccatgagtatgttatctagatcgggttgcgcaccgcaatagtgtgatgttgagcatagctttccatgtgtttatttgtattccttgcttcctggcttccgaggggagtccgcaatgagaattgcttggcgaatagcgtattggttgtgtcctttcaggacagagtagtgtatattacttatttcaccgtgagtgtgatgggtgattgggtttcgagcatcgatctgtgcatggctgtctactttgagcatggtaacacgaggtgattcgtgtgtaacaaagttgagttaggatcgcacgttgtggcgaggccacgtggaattatgacctctcgaggaagatttaggtactctatccctatgatgtgagacggggtctcagcttggttttgtaaaggtattgatgagcttgaggtaaaactcttccggttgagtcaattgtcctgatttgggtatgtacagactgtttcttattggcgcatgtattatgcaaattgcggcttagacttgtattgaggtatcatctcgctatgagtggtgtgttagattcgaggtgataattggggtcaataatgaatacgaacagatttgattgcggcaggttagaaggataatatcgaggttctggcccgaaaaccagttgtggtaatagtcaacatggaagtgacttcgtgaatggttgatctgaaggactgctacattcattgcgtattttggctatcattggcagtatacaaatgtgttggggtaagactttagctaaatgagaggttttctgttggtaattgagtattgtgggcaactgctatgaattgagactatcgttccgagtgttgaaatgtgtggtatattatatgaattcacctgaggttgcaggtgtggttgttacaactggttcgggttaattctgagtatagatgtgaggttcggatcttgtgtatgatttcgggtagtgcagtgtggttctacggtttatgtgccagatggattgtgaaattttagctgtgttgtgttatcggtacctatgtgagttggagtgacgtgggatcaccccgggcgtatgcttggtaatttcacttggctattgggttgcttctagtacagctctgggtacgctcgaggacgagcgtttgtttaagttggggaggatgtgacgacccgacccgtcgtctattgtatcttcatcccgttatccccgttatatgtttccccatgtgttgacatacgtgtttggtgaggctgaagtggttcgggttgaaattggatagaaatgagacaaatagtctctttaaggaaagcttaagttggaaaaaaagtcaacccaacgttgacttatgagtttgagggctcggaatggattttcgatggttcgactagtttcgggggatgattcatgacttaggaatgaaaacggaagtgaattcggaggtccggtgtgaaagttagcttagattggcgaagttggaatttcggagaaatccggttgataggtgagattttgatccgagagtcggaatggaattccgagagttgctgtagcttcattatattattttagacttgcatgcaaaatttgaagtcaatcggacgtgattcgataggtttcggcatcgagaatagaagttggaaacttccaagttcatcaagctgggattggaggttgattcatgattttagcgttgattgatgtgatttgaggcctcgactagttccgtgatgtgttttcagacttgttggtgcttttggttgaggtcccgggggcctcgggtgagtacggacaccccggaacttagaaaaatggaaggggcagcagtggtggtgcggaccgcacatcttttcgtgcggccgcgcaggtaaggaacccgcagcgtcactagtcctgctttggaagatcataactctttatctataagaaaatttgaggtgattcaaaaacgaaagttttatcccttcgtgtctagtttccagaaagctaaggaaatagtaatttggacatctgtagcgaaagttatggccaaaatactaaagggtatcgcagcagccaaaagctgtgcggccgcgaccatttgtgtgcggaccgcacaggttggatgcggccgcgtgccatttttgtgcggtcagcacagctgggatccgaggggtacatgtataaatacgagattttgggttttatttgatattttacccatgggagctcggattttggcgatttttcaaaggtttttcaagaaattcatcggggtaaataattctaactcaaatttggttgaagtacatgaatataccattgaattcatcatttaattagtgatttgagatggaaatttgaagaactagggtttggtttttgaaataaaaatttgggatttgagggagcatttgaactccgattttggtaaactttatacgtatagactcgtggcgagacgagggtcattttgatgtaaaagtttctagatttcgagacgtggtcccggggctcgagtttttctaacttcgtgattttcgatgtttttcgagttcttttgattgggttatgttccattagccttatgtaatatattcgttgtggtttggccagattcgtcgctcgtagtggaggatttgaagataaaaggcatttcgggctagtttccggccggcttgaggtgagtaatgggtgcatatgactacttgagggttcggaaccccggtatgtcacattgtgacgctatgatgaggctagacacgcactccatggtagtgcggggtcgtgtgtgatgtgaactgtgactcggttcaatccgagggacacgttgtgctatgttagcgattgcttcgctctatatattgctgatatctgggcttgatgccatgtttggggccatgtgccgacttgtataatccttcagggattgatattgttgaatcatcatgacatgcatattatttgactacagtccaaaggttttaaactcggtttgcgaactcagccttacttctatatttttaaactcaaatggcttttaaatgatattttgtactgcatatgattcatgaacggtggtaactattggcaccgtggattgtgatgaaaacggtggtaactattggcaccgtggattataatgaacattggtaactattggcactgtatgatatagcgcttgggctgtaggagcccctccggagtctgaacccccacagtgagcgcgggtacccatatggatggctcggactgcacgccgcagtggacatgcattgctttgcattcatgcatctattatctggcattttacctggttaattctgtgtgatgtactgtatagaaatgttaaatgtagctttgctgtgtgcgtattgtggatttccttccgtcaggttttatatccatttattactcactgagttggtagactcaccccatactccctgcaccttgtgtgcagatccaggtgtcccgaaggcatagtgagctgctgttgccgatatcagatcgtagcggagatttgaggtagctgccagcgtccgcaggacccacttctccaatcttttgatttcctttcagtcttcagacattgtactttctttttgtcatatttgtatactatattcggtagaggctcagtactcgtgacccttgattttggggtattttgtttggattctagttctgctattcgtatcgttttggtccctgattggggatgttacggattcatatttgtccctttatggactgggaatctctttcttgggtatgtttggtcgggcttgcctagccttgcggctgggcgccatcgcgatcgggatttgggtcgtgacagtatagatatacatatatcggtgcaaggagcaataacaagagaatacaagcaaagctgggagggggacatgctatcggggagtaacaggtgaaagtggaatatcataattaacaaataatgagatggaacggaataataacatcagctaaggagaacaggtaaatcaacaactgcacggcaccaaccatcgtgctttaactctcgttctccccaaaacaatcaaataaagtaaatcgatggctacacggcatcaaccatcgtgctttgtcactcttccttttcccaagcgataatgtaaagtaaatcattaattacacggcatcatccatcgtgctttatcgctcatcctcacccaagcaacaatcacaacagttgggcgagagaataaacaagtaatatccgaaatcccggcaagggaacacaattaagcaattaaacctcggcaagggaacacaagtaaacaattaggtcccgacaagggaacaatttagtaattctttctctttctttcactttcatttcataactcactttaccacttgagccaatgctccaaagggcacaatcaactcataaactttcacatttcattttataatttcataatacaacttgagccattgctccaaagtgttcaagtaccacaattacttcactaactttcctcaacaagtagaaatcatctttagagaatatattcttcaacacaatcataaaattcatatcatattactcgaattaaacaatttaagactcacggtcatgctagactcgggtgcatagataaacgtcaccatgcctatacacggactccacaattagcacatagcaaataatatcctaatcctattccctcaagccaaagttaggtcaaatacttacctcgatccgaaaatagcaatcaagcctctaacaccgccattcctctagaatccgactcccaaacaacgataactaggcataattaggttcaatattatcaataagggtccaaaaacatcatcccatagcttagaaatgcatttcctaactttcttccaaaattaccaaaatccggccccgggcccacatggtccaaactcgaggctcggaccaaaacccaatcctccataaccccacgagttcaaatatgcaattagttttaagattcgacctcaaattgaggttgaatcgtccaaaatcccaataaccctagttctacccaaatcccctaattcctaccttgattttatgttttagggctaggaaattaatgattagatgaagaaatagtgaggaaatgaagttagtattacttacccaaagagatgtgaagaaggtagaacttgaatttcattaatggaggattttaggagagagctcgtgtgaaagatggtagaaatcccgagcacactgattctgtttttaacttaaaatcactggacgaaaactgctctatgcgatcgcataagaaggagtgcgattgcatagagtggggctggtgagactttgcgatcgcgaaggtccaatgtgttcgcatagaggaagttttttttgggtttctgaggaaaacactatgcgttcgtggaggatctatgcgaacgcatagaagaaactgggggggggggggggggggggagggactggtttgcactatgtgaacgcgggaggggaatgcgttcgcatacaagaaaactctgggcttgacatttgcactatgcgaacgcggatgagtaatgcgttcgcatagaagaaatcttgcctgcaacagagatgaaaaatctgctgcattttcgaagttcaaaataccccgaactatccccaaaaacactcccgagccctcggggctcccaaccaaacacacacactaactaattaacatcttacgaacttagtcgagcgatcaaatcgccaaaataacatcaaaattaattaattaaacctcaaattcttcattttcccattttaacttcaaaacctctaactttagattcttaggtccgaaacacatcaaacgacgtccgatttcgaacaaacttcacagataacgcttaaaccacatatctgacctgtaccgggtatcggaaccaaaatacgagcccgataccattactttttgatcaaattacattttcattttccttaaacattttcagaaaataatttcatggaaaaattctttcctcgggcttgggacctcggatttcgactctgggaatacgcccgagtcccatatttttctatggaccctccagaaccgtatgatcacgggtccgggtccgtttacccagaatatttaccacagtcaaccatatcaatattataatcaattttcataatttttgacacacaattcatatcctttcacataaaatttttttggcttcacgcccggactatgcatgcaaatcgaggtaaccaattaagaggttttcaaggcctcgaaagcatggaacaggggagaattatggtgatgaccctttgggtcgtcacagttcccttgccgggacgttgttgtatctgttgctgactcccttgtcgggatgttgttgttttgttgctgctggcgtacatttacattgggactacggatatgggattccggtagcttccccttgtttgtttacattgggactacgaatgtgggattccgggagatctccctacacaattatatggaactacggcaatgcagccgatagattcccccagtactgggtattgatccaaacatttactttgggactatgggacgatatcccggtagatccccctgcacattgatggttggactacggaatggtattccaggagatccttcggatatatatatatatatatatatatatatatatatatatatatatatatatatatatatatatatatatatatatatatatatatatatatatatatacatgatggacaacgggacgatatctcgggagatccattggacagttaagagagagaggactacaggacggtatcctgggagatcctcatggaatctttggcattgagctgcaccttttcatgttatttctgtatttcgttcaattgttgttgacatgtatattatgtcttgatttgctgtagttgtgcaaatatttcgggtgatggtcgtgccatttattatacctactagttggtaggatcctggttaatcacacttgcacaagcatacacgtagctggacaccccattagaggtgaatcccttccggtttggctaagggtgaggtacgccctcgtatccattatatatgtgagagtagtcctagttagccagttagttgtcagcctgaccgtgagatttatagggcacatgatgccgagtgttagacttcaggtgctgggtttctcgtgagttgtggtttttacgagatttggtaaagattgtggatagagctgaatgagaccttatgtgaacatcattattaggatatgagttattgacttgttttcccttgctgtgtgatgaccttagggtttggattgcgattctgccttcattcgtatcatcatttattatattctcgttgcaacttgttgcccttttccttattgtgaattgtagcattttcagtcattcatgcagcctttacataattatataacgtctccattattcttatgattttattgtctattgaccggtaggtgtcttgattgttcctcgtcactactccatcgaggttagtcttgatacttactgggcaccgctgtggttggctcatgctactcttctgctcactttgttgtgcagatacaggtactcccatttagttctgtcagccttggaaagaggcgcaccggtagagactttgaggtatgtctgctgcatccgcagatcaaggagtccctttccagcttctttagtaagtacagttcttccagtatattcatttgtataaacattcttgagtcagatcccttatgtacccccttagcttgtgatttgtgagatttcaggttttgggaacctgattagttatgagagttgatgttgtatgtgccaggcggcaccttgagcattgatttatttatttggttcaatttaaaaatattttcttccgcaattggtttaatttccgcatttgttagtcttacctagtcgtagcgactaggcgccatcacgacatgttaaccgagggcgaactagggtcgtgacaaaagtcatagagacaattgaaagaacccaacaaccacttgactttccttctccggcacttgaagctcctatagctgatgaacctttaaatgacgaagccgttgatgtggttgttgaagttgaaaatgttgtaattccagctcccaagggtaaaacttctatgactcagtctgtggaagctgaagcttccgtgactcttgctcccctcgtcgaacttaacatttcaaacccaactgaaaccgctcatgttgctgcttcttcagaagttaccaccgtagctgtggttgttcctgaaagtgaagccgatatagcaacttctgtcaatccagcctcttagtgaacagtttatgtttcttgactttgtttttatttattttatttattggtggttttatcccttggcagtttttaagggattttttggaaaagtccccagctatcataatgtggcacttgtaaaattattttgttgactaagtttttacatagtctttttaaatagattaagaagttttctcagtacttctatatgttctattccttcctttttatttattttggacttatagaatagcttagcatttttatcctttgaaaatgctttatgattcttctcatgagttattaacatgaggtttataaaagagggcccttttatatatatcgacactcaatgaagaagacgtctcaacttcataatagtgttataatacgatgaaagaaataggaacacacatgttttgattaaaacaactttgacaagtttttattcatgaacttggacaagcttttaaatattacatgtattaaaatacatctataacttttttcgtaactgtttttcttatgaaaacacatgattagggatgttacgtgtcagaaattccgggagatttgggctcattaattgctggccggagttccttgtccgtcagtaagttttctagtttcttttattatttcagtttttcattctgtttagttgaatgtgtaagttccggaacctttgtttgatattaattctagttggcttgaacttcataattagttagttagattgtcagattagttcatttcattaattgattatttgtctgaatagtttgattgttaggtattcgaatagtcaattggcttagttgtatttcctttatataatctgctcttattgttaggattcatttaaatttaggcagttttgaaagtgattagtcctcatctaactaaatgggttttggtaaaagtcgatcagtgttaattagtgttcaaggtcattctaggtaattggtgggtacaagaataacatagaataccctatgagtttctagacaggggactttaagtaatttgtgtaaaatagtaatgttttcttgtgtgtcaagttagaagtacagggggtaaaaggtaattaaatcagggacagaattgaaaatagggagttgtttgtttacctataaataggcattgcatgtgccttgtgaagggggtcttctccttagcaatttttgagctcactgaaacacttctctcattcgaagaagaccatcttaatttcagaaaaacaaacaaaaataaacagaattcaaaaataaaaaatggcaattactgtttcattgagatcttagtttaagttcaagtccttttgagtatatgattgttgtttctgatagctactggtcgatttcgaggcataaatgattgctggaattttttgggttgttttgaggctattcgagtttgagttgtggtgttatccgaaattctaaaaacattcctgggtttgaggcattttctgggctgttttactttactactggagtttatttaggcactcatattattggaaattagttgattgctgctgttgttgcactgattcgctgacctcccctttgttcttctttgaatcctcattttccaggtacttgttcgaaacttgcaagtgtatgtgtttgaattgaagctggaatgaaatggctcttatggaatttaatgtatttgaattgttagtagagtaacggatctatataaacttagtttggtttaatctatataactgggctaatgaaattgcttgatttggtttagtatgtataattggacttataaaactgttataatagtgccttcacttcgttttaatgtgatataactcttcagttagacctcttagctaattcgtggtgtgtaaaaagtaactgatggctgttgttgcttggatactgttgggtaataaatcattctaggattcaaattgatatttgtttaagggtaataactatgctaattagatgccacttgactttgaagtctagtttggaatttgcaaagcatgattcataattagtttaatatatccgttgttttgattaaactattagattaattttgataagtatttgagtctgttttgttttgtgctagtttagttaaaataatcaggccttcagcaaataataaaacagtgggtcaattcggcggggggttggatttgggatttcgatgaattattgtgctaaaagggaccatgctagtttagggactcgatccccggccctgactgaggctattccgtcaagcccagattaggcctgcctcagacccacgcttttgactgtcaaaaggtgtcacgaaacctagttcaccaactgtaaacatgtcatgatggcacctggtcggcgagaccaaataagcctaattcaatgcggaacataacaatcataatggaaagatcaacaaaactaaataacatagagaaatgtaataggtgccgcctggcacatacacttaacaatgtaatcatcctgaaaactatcccaaagacccgaaaactcacatgcaacataggactagaagaatgtaataaagctctaatgtctgaaatatctagtacaacggaaacagtaagggaaaacaataatactagctatggtagaaatgacggagactatctggtctacgaacgcagcagtatacctcaagtccccgatagcaactccggactcactgatgatacgcgtgccagatatacctggatctgcacaacaaaagtgtgcagaagagtagcatgagtacaccacagcggtactcagtaagtgccaagcctaacctcggttgggtagtgacgaggaaggtggaggccctactgagataaacaagtagagaataacgatatatagatgaacagttaatttaataagagagacaacagtaataacagagattacgaataactaacagtcaaagaagacaagatatacacagtagaacaccaatcaataccaagtactcagaggatctcccaggataccgtcctgtagtctttccattaactgcttcagaggatcccccgggataccgtcctgtagtccttctcatctttctatctgaaggatctcccaggataccgccccgtagtccaactttccaatgtgcaaggggagctaccggaatccgacatccgtagtcccaaaataaacaacaaaggggatctaccggaatcccacatccgtagtcccaatttaaatgcgcaaacacaaccaagaatatacaggaattgaaccatgaaccaccaacagatagagcaaactagcctaacatgctgcacatagcacaataagagcaaaataagcatttgaacaattaattctatctaatcatgctttcctaactaacacaggttgaactgacattttataacagtcaaataagtgagaaaacacagtataagaaattcaagtaaggtggattttcaacaattagcacaagtgcatgctcgtcacctcgtacacaaggcatttaaatcaacaaacaagtaatcctaagggaagaagtcccccacgcaaggttagacaagccacttacctcgaaccggcacaaaaaccactacaaagcgatgcccttgccacgagtatccaactccgaattgaccgaatctaatcaaactaattacataacataataacatcgcaagtaactaattacactaataaaattgaagttacatcatgaaaataattaaaatgaccaaaacgcccctcaggacaacatctcggaatcgaataatttttacattattcagaaacctcgtactctcacgagtctaaccatataaaattctcccaaatcagaggtcaaatgcctcttcaaatcattaaagtttggtctaagaactttaccccaattttcataccaaatccgaaattaaagcttgaatttgagattagattagtgggtaataatcataagggagtgaggaatcgttacccaatcgttgcctctgaaaatccctcaaaaaatctcccaaaaccgagctccctagcttgagtttttgtaaaaatggaagaagggttcgtgtttgaaatgttaagtactggtcaggggtttaatgaatcgcgaacgcgggaggtcaacgcgttcgcgtagaggaaaaatgtaagtgaccagtttttcccttcgcgactgcgaagggacaatgcgattgcgaaggcttgaggcctggtagctacgcgaacacgaccagcatacacgaacgcggagaaggaaatgaagggggtccaggacttgaacatcgtgaatgcgtgaaatgggatgcgaacgcggaaaaggggctggctgaacttcgcgaacgcgcggaatacaatgcgaacgcgatgaaggggtaagggcacagctacgggagcgcgatacccctcgcgatcgcgtagaaggaaacactgcctgcaattttctgctgcactttcaaagctccaattgctccgttgagcatccgaaacacacccgaggcccccgggacctcaaccaaacctacgaacatatcctataacatcatttggacttgtaccaatccttaaaccaccaaaaataatgccagaaactcgaattaaccaatgatttgaacttagaaatttcaaaacttaaccaaactcactttcgattcaaaacctaaccaaaaaacatccgattgacctgaaattttgcccgcacgtcccaaatgacatgacggtgctacaacaacttccggaatcccgttccgacccttggatcaaaaattcactatcggaccggaaacttcaaattttcaactttcggcatttctagcctaattgagctacggacatccaaaactcattccggtcatgctcccaaccctgaaatcacctaacggagctaacagaaccatcatatttccattccgaggttgtcctgacattgttccgactacagaccattttccattatttaatctcttaaatatggactatttgtcccaaaacactccggattcagataccgaacatcccggcagaccaaaatagcataaataaacttaggggacgcagttaatggggaaacggggcgcaaatactaaaaaagactggccgggtcgttacatcctcccacacttaaacattcgttcatcctcgaacgagcatagagaacatacctgaagtagcaaatagatgggggtaacggctgcacatatcccgctcggtctcccaagtcacctcctcggttgcgtggccccgccactgaaccttcactgatactatctccttagacctaagttttcgaacctgcctgactaaaatttccacaggctccttaacataggacaagtccttgtctaactggactaaagtgaactccaacacatgagacggatcaccgtgatacctccgaatcatcgaaacatgaaataccggatgaaccccagtcaaactaggaggtaaggcaaactcataagcaacctccctaactcgcctcaaaatctcaaagggaccgataaacctcgaactcaactattcgttttttccgaacctcatgacgcctttcataggtgtgacccgaagcagaaccttccggtccacataactcttctgtctggactgggcagtacggagtcgatcctgaatcaccttaactttctccaccacatcctgcacaaaatctgtacccaatagtctcgcctcacccggctcgaaccaacccaccggagacctgcatctcttaccatataaagccttatacggcgccatctggatgctagactgataactattattgtaagcaaactccgccaatggcaagaggtgatcccaagaccctctaaagtcaatcacacacgcacgaagcatatcctcaagaatctgaatattgcgctcgggctgcccatccgtctgagggtgaaatattgtgctcatggtcaactgagtacccaaatcctgctgaacggccctctagaaccgtgatgtgaactgagaacccctgtttgagatgatagaaactggaatgtcgtgcagacggataatctccctgatataaatacccgctaaccgctccgctgagtaagtagtgcacaccggaataaaatgagccgacttggtcagccgatccataataacccaaatagaatcaaacttcttcgcagtcaaagggagaccaactacgaaatccatggtgattttctcccatttccactctggaatctcaatctgctgaagtaattcgcccggcctctggtgctcagcctttacctgctggcagttgaggcatttggctacaaattctgctatatctttcttcattcgcctccaccagtaatgctgcctcaaatcgtggtacatcttcgcggcacctggatggatggaataccgcgagctatgagcctctgccagtatcacttcccgaatatcatccacatcgggtacacagatccgaccctgcatccttaatacctcgtcctctccaattgacacattcctggcatcgcgaagctcaaccctacccttgagatcaagtaaatgggggtcatgatactgccgctccctgatacgatcaaataaagaagatttagagaccacacaagctagaacccgactgggctccgaaaggttcaatctcacaaactggctggctaaggcctgaatatccatcgccataggcctctcagctgctggtagatatgccaaactacccaaactctctgcccagcgactcaaagcgtcggccaccacattggccttgctcggatggtacagaatagtgatgtcatagtctttcaatagctctaaccaccttcagtggcgcaaattcagatccttatgcttaaacaagtgctgcaaactccgatgatctatataaatctcacaaggcacgccatgcaaatagtgatgccggatcttcaaggcatgaacaatagcagctaactcgagatcatggataggataatttttctcatgtactttcaactgtctggacgtgtaggcaatcaccctaccgtcctgcatcaataccgctccaagaccaatcctcgaggcatcacaatagatagtataagaaccgaacctgtcggcagaataagaactggggctgtagtcaaagctatcttgagcttctgaaagctcgcctagcactcttccgtccattggaacggagcacccttctaggtcagtctagtcataggtgctgcgatagaagaaaacccctcaacaaagaagttgtatgcaaagttctctaaatgtgagttctggttgaggcctggtaggtacgcgaacgcgaccagcatacgcgaacgcggagaaggaaatgaaggaggtccaggacttgaacatcgtgaatgcgtgaaatgggacgcgaacgcagaagaggggatggctggacttcgcgaacgcggggaatacgatgcgaacgcgatgaaggggtaagggcacatctacgcgagcgcgataccccctcgcgatcgcgtagaaggaaacactgcctgcaattttctactgcactttcaaagctccaattgctccgttgagcatccgaaacacacccgaagccccaggacctcaaccaaacctatgaaaatatcccataacatcatttggatttgtaccaatccttaaaccaccaaaaacaatgccagaaactcgaattaatcaatgatttgaacttagaaatttcaaaacttaaccaaactcgctttcgattcaaaacctaaccaaaacacgtccgattgacctgaaattttgcccgcacgtcccaaatgaaatgacgatgctacaaaaacttctggaatcccgttccgaccctcggatcaaaaattcactatcggaccggaaattcaaatttcatactttcggcatttctagcctaattgagcttcggatatccaaaacacattccggtcacgctcccaaccccgaaatcacctaaaagagctaacggaaccatcagatttccattccgaggttgtcttgacattgttccgactacagaccattttccaacacttaatctctcaaatagggactatttgtcccaaaacactccggattcagataccgaacataccggcagaccaaaatagaatacataaacttaggggaagcagttaatagggaaacgaggcgcaaattctaaaaaagacaggccgggtcgttacatcctcccacacttaaacattagttcgtcctcgaacgagcatagagaacatgcctgaagtagcaaatagatgagggtaatggctgtgcatatcccgatcggtctcccaagttgtctcctcggtcggctggccccgccactgaaccttcacagagactatctccttagacctgagttttcgaacctgcctgtctaaaattgccacaggctcctcaacataggacaagtccttgtccaactggactgaagtgaactccaacatttgagacggatcaccgtgatacctccaaagcatcgagacatgaaataccggatgaaccccagtcaaactgggaggtaaggaaaactcataagcatcctccccaactcacctcaaaatctcaaagggaccgataaacctcggactcaactttccattttttccgaacctcatgacgcctttcataggtgagacccgaagcagaacccactcaccaaccataaaggaaacatcgcgaaccttctggtccacataactcttctgtctggactgggttgtacggagtcgatcctgaatcaccttaactttctccaccacgtcctgcaccaaatctgtacccaatagtctcgcctcacccggctcgaaccaacccaccggagacctgcatcacttaccatataaagcctcatacggcgccatctggatgctagactgataactattattgtaagcaaactccgccaatggcaagagctgatcccaagaccctctaaagttaatcacacacgcacgaagcatatcctcaagaatctgaatagtgcgctcggactgcccgtccgtctgagggtgaaatattgtgctcatggtcaactgagtacccaactcctgctgaacggccctccagaaccgtgatatgaactgagaacctctgtttgagatgatagaaactggaatttcgtgcagacggacaatctccctgatataaatacccgctaaccgctttgctgagtaagtagtgcacaccggaataaaatgagcggacttggtcacccgatcaacaataacccaaataaaatcaaacttcttcgcagtcatagggagaccaactacgaaatccatggtgattttctcccatttccactctggaatctcaatctgctgaagtaatccgcccggcctctggtgctcagcctttacctgctggcagttgaggcatttggctacaaattctgctatatctttcttcattcgcctccaccagtaattctgcctcaaatcctggtacatcttcgccacacctggatggatggaataccgcgagctatgagcctcggctagtatcaactcccgaatatcatcaacatcgggtacacagatctgaccctgcatcctcaatacctcgtcctctccaattgacacattcctgacatcgccaagctcaaccctacccttgagatcaagtaaatgggggtcatcatgctgcctctccctgatacgatcaaacaaagaagaactagagaccacacaagctagaacccgaccgggctccgaaaggtccaatctcacaaactggctggctaaggcctgaacatctattgccataggcctctcagctgctggtagatatgccgaactacccaaactctctgcccgacgactcaaagcgtcggccaccacattggccttgcccggatggtacagaatagtgatgtcatagtctttcaataactctaaccacctcctctggcgcaaattcagatccttatgcttaaacaagtgctgcaaactccgatgatctatataaatctcacaaggcacgtcatgcaaatagtgacgccggatcttcaaggcatgaacaatagtagctaactcgagatcatggataggataattcttctcatgtactttcaactgtctggacgcgtagacaatcaccctaccgtcatgcatcaataccgctccaagaccaatcctcgaggcatcacaatagacaatataagaacccgaacttgtaggcaaaataagaactaggttgtagtcaaagctgtcttgagcttctgaaagctcgcctcgcactcttccgtccactggaacggagcacccttctgggtcagtctattcataggtgttacgatagaagaaaacccctcaaaaaatcgacggtaataacccgccaagccaagaaaactgcgaatctcaatcgcggaggaaggtctaggccaactctgtactgcctctaccttcttcggatcaactcgaataccctcgctcgacaccacgtgacccaagaagtccacagaatccaaccagaactcacatttagagaactttgcatacaacttcttttctctcaaagcctgaagcactgtcctcatatgttgctcgtgctcttcctgactccgggagtaaacaagaatatcatctatgaacacaataacgaaagagatacggcctgaacacactgtgcatcaaatgcataaaggctgctggggaattggtcagcctaaatgacataactaaaaacttgtaatggccatatcgagtcctgaaggcagtcttcgggatatccggctcccgaatcttcaacagatagtaccctgagtgaaaatcaatcttagaaaacacctgagcgccctgaatcatgtcaaagagatcattaatacgagcaaaaggatagtggttcttcactgtaaccttattcaattgacgataatcgatgcacatacgcatagaaccatcctttttcttcacaaataagacaggagcacctcacggtgaaatactagggcgaataaaacccttatcaagcaactcctgtaactgatctttcaactccttcaactcaggaggagccatacggtaaggaggaatggatatgggctgagtgcccggccattgatcaataccaaaatcaatgtcccgatcgggcggcatgcctggaagatcaactggaaatacatcgggatagtcccgtactactgggacagaatcaacataaagggtatccacactgacatctctcacataagccaaatacgcgacacaccccttttaaaccatacgctgagctttaagaaaagatataactctattgggagtgtaatcaacagtaccactccactcaatgcgtggaacacctggcatagccagcgtcatggtcttagcgtgacaatcaagaatagcaaaatggggcgacaaccagtccatgcccaagataatatcaaaatccaccatatggagtaataaaagatctgctctggtctcaaaaccacggaaagtaaccaaacacgaccgataaacgcgatcaacaacaagagaatctcccatagaagtagaaacataaacaggagaactcaaagaatcccgggctacgcccaaatatggagcaaaataagaagatacataagaataagtagagcctagatcgaatagaaccgatgcatcccggtgaaaaaccagtataatacctgtgatgacaaagtcggaggcaacaacctcggtacgagcaggcatagcataatatcgggcctggcctcccccttaagggcgacctctacctcccctaccctcgcccctagctggctgggcaagtggggtggcagctggagctggaacaatagcctgggaaccctgtggagcacactgaggctgtggagtttgagaagatacacacctccccagtctggggcaatccctaaccatgtggcgcgaatgaccacactcataacaagctctgggagggctcggtggctgtgactgactgggtccgcccctgtaggaggcgcgctagaaatcagaggtgcatagtagggttcctgagatctgggaggagctaaagggccgctggatgaaggaagtgctgagtgaactgggagacccatatagcccctaccgtgatgacctgctgatggagtccgggtaccagagtagcgacccgactctcgagacctcttggcctccctctcatcacgctccctggcgtgaagaccctcaatcctccgagcaatgttcactacttgctgataaggaatgtccatctcaagatctcgggctatgctagatctgataggagaaataaggccctctatgaacctgtgaaccctctcgcgaacggtggcaaccaaagcaggtgcgtgcctagccaacctggtataacgaatggcatactcagaaacactcatagtgccttagcgcagatgctcgaactcctgatgccacgcatccctgaggctctggggaacaaactccctctcaaacatagcagaaaactgtgcccagctcagggaggcagcctggtccggactgtctagctcatacgtacgccaccaatcataggcagctccccgaaaccagaaagctgaaaaagaaaccccactcatagcagtgatacccatagtgcgtaaaatgcggtgacagtcctccaaatactccaaggcatcctccatggctaatccactgaacaccggaggctcatacttcttaaacctctctagtctcatctgctcatcctctgaggcaggtatctcatcctccggctgaaccggtgcagcaggctggacatgaatgacaccaggagcctactcaacatgcactcgctgctctggagtgcgggcggcgagagtctgtgctcctctcccggcctgggaagtggctgcaggaaggggtagcagccctgtctaagacaatgcactataagcactcatgaactgggccagtgcctcctggatagctggagtagtagcggctgtgggcgtgtcgggcgtctgagccccgactggaatggttggcggtacctcagcggcggctcacgcaggtgctctagctgcacgacctcggccccagcccatgcctctagcagctgtaggagggggtacaggtgcctgatcaacttgggtcgtgcgtgtcctcaccatctgtgagagaatagaaagacagaagttagatttggcatccaaaaagatcacacgacaaggaattaaataaagtgaagatttttcctaaacagttgcgtagcccctcgtagataagtacagacatctccgtaccgatcagcgaggttctaacaaaccggcctgtgtcccgtgactcctatgaacctagagctatgataccaacttgtcacgaccctagttcaccaactatgaatatgtcgtggtggcacctggtcggcgagaccaggtaagcctaattcaatgcggaacataacaatcatgatggaaagataaaaaaaactaaataacatagagaaatgtaataggtgccgcctggcacatacacttaacaatgtaatcatcctgaaaactatcccaaaacccggaaactcacgggcaacacaggactagaagaatgtaataaagctctaatgtctgaaatgtctagtacaacgaaaatagtaagggaaaacaataatgctagctacggtagaaatgatagagactatctggtctacgaacgcagcagtatacctcaagtccccgatagcaactccggactcactaatgatacgccgtgccagatatacctggatctgcacaacaaaagtgtgcagaagagtagcatgagtacactacagtaagtgcaacgcctaacctcgattgggtagtgatgagaaaggtcgtggccctactgagataaacaagtagagaataacgatatatagatgaacagttaatttaataagagagaaaatagtaataacagaaattactaataactaacagtcaaagaagaaaagatatacatagtagaacaccaattaataccaagtactcagaggatctcccaggataccgtcctgtagtccttccattaactacctcagaggatcccccgggataccgtcccatagtccgtctcatctttttatccgaaggatctcccgggataccgccccgtagtccaacttaccaatgtgcaaggggagctaccagaatcccacatccatagtcccaaaataagcaacaaaggggatctaccggaatcccacatccgtagtcccaataagcatttgaacaattaattctatctaatcatgatttcctaactaacacaggttgaactggcattttataacaatcgaataagcgagaaaacacagtataagaaattcaagtaaggtggattttcaacaattagcacaagtgcatgctcctcacctcgcacacaaggcatttaaatcaacaaacaagtaatcctaagggaagaagtcccccacgcaaggtcagataagtcacttacctcgaaccggcacaaaaaccactacaaagcgatgcccttgccatgagtatcaaactccgaatggcccgaatctaatcaaaccaattacataacataaataaaattgcaagtaactaattacactaataaaattgaaggtacggcgcgaaaataggtaaaataaccaaaacgcccctaagtccaatatctcggaatcagataatttttacatttttagaaacctcgtactctcacgagtctaaccatataaaattctcccaaatcgaaggtcaaatgcccctacaaatcatcaacatttggtttaagaactttaccccaattttcataccaaatacgaaattaaagcttgaatttgagattagattagtgggtaataatcataagggagtaaggaatcgttacccaattgttgcctctgaaaatccctcgaaaaatctcccaaaaccgagctctctagcttgaatttttgtaaaaatggaataagggttcgtgtttgaaatgttaagtactggtcaggggtttaatgaatcgcgaacacgagaggtccacgcgttcgcgtagaggaaaaatgtaagtgaccagttttgcccttcgcgatcgcgaggggacaatgcaaacgcgaaggcttgaggcctggtaggtacgcgaacgcgaccagcatacgcgaacgcggagaaggaaatgaagggggtccaggacttgaacatcgcgaatgcgtgaaatgggacgcgaacgcagggaatacaatgcgaacgcgatgaaggtgtaagggcacagctacgtgaacgcgatgccccttcacgatcgcgtagaaggaaatactgcctgcaattttctgctgcactttcaaagctccaattgctccattgagcatctgaaacacacccgaggcccccgggacctcaaccaaacctacgaacatatcccataacatcatttggacttataccaatccttaatgcaccaaaaataatgccggaaactcgaattaaccaatgattagaacttagaaattttaaaacttaaccaaactcgctttcaattcaaaacctaaccaaaacacgtccggttaacctgaaattttgcccgcatgtcccaaatgatatgatagtgctacagcatttttcggaatcccgtttcgaccctcggataaaaaattcaccatcggaccggaaacttcaaatttccaactttcggcatttctagcctaattgagctacggacatccaaaacacattccggatacccctcccaaccccgaaatcacctaacggagctaacagaaccatcagatttccattccgaggttgtctttacactattccgactacgaaacattttccaatacttaagctctcaaatagggactgtttgtcccaaaacactccggatttagataccgaacatcccgacagaccaaaatagcataaataaacttaggggaagtagttaatggggaaagggggcacaaattctaaaaatgaccggccaggtcgttacaaaaggtccagtccggtctgtacattggattgatagacccaatcttgaaatagctaggttagtctgataatgtttacatagccacttgaggtggtttccgttaaccaattaactaaggttttctttttccttttatttgacacgttaagtagatgatagtagttgcccttaagtttgacgttaaaacagtgagatgagcctcgctaaataaaaacaaaaatgcgggaccctcaataattgttctataaatttacttagaattttggagggtcgtttagtgaatttcacggccttccccaaaaattttataatacgttagaatgtttatgcacgatctaattaatttactttcttaaactcgggtgtgcattgatgcggcccaaatccaaatctcaacgaagtcggaatttgttgacaaccacgggtgcattgattgcgacgtggttcggaatgcgttttcacgacgtcgcaattctttgaaaataaataacgataaaaagagatatacgaataaaaggcatacaagctagcatgtcttcaaatcaggtaaaatcaaatacaacagttgagcgactgtgctagaaccacggaacccgagaatggctaacaccttctcccgggttaacagaattccttatccggatttctggttcgcggaccattaacagagtcatagttttcctcggttcgggattcaaccggtgacttgggacaccattaatctcccaagtggagactttgaataattaataattaaatcccattccgattgtcctttaagtggaaaaactcctttatgcccttgcgggtgtagtgaaaaaggaggtgtgacagctctggcgactctgctggggagaagaacccagaacgttttgttcacggttcaaaattcgagcttagataaattgttgtacttggttatatatgattttcctacatgctttgtgctgaatgtgctaaatgttaccgctttgatattatttgaactgtatataaactgtgccgacactcttctctcttcacccccggggatgtgcttactggttgagactcctcattctcttagtgtaacaccctgaaataaaaaaaggctcggacaagttacaaagccagacgatctcgcgggtcaccggtacgttgctccctcctcgagagttgtccactcgggtacactgtttagaacacagacccaagttttggacatagaataacgtgacttcatgccggatccttattaggaacgtttatttgcatcatgttgcatttgacttaggggactcaacacagggtttgggtccgtctaggaatagcaacctgaaatgaaaatgaccatcctgatgcatcctacttctgctgtgcatctatttgtttcgaacctgcatgttgaccggtttctgaatcccgggaatgttggaaaattgagaaaaagagaaaaaagggaaaaaagaaaaaaagagaaatagtagttagggagttaagtaattttcttagaaaaccaaggctcaagtactgtcggaactctgtcaaaattttgagaaaatagaaaaaaatattttactttaaattgtttgttttacccaaaaggaaaaaaatgtgtggcaaagagtcttttattttagttgtttggttttcaaaaatagaaacggaaaaatagttttaccatgaaaaatgaaaaagagtcttgattttggatttcttgtttttaaaatagtttatttgccaatgaaaaagaaaaatagttgtttgttcgatataaaagaaaaaggatttttgttttcaaaattagttagtttatttgcccgaactacaccggtttgattctcacagggtgttagatacataggcaaccctcatcgggtccaacctttcctttgcaaaaatagttaaaatgtcaaaaaaaattaattttcgtcataaataagtcaggtgacgccgttttgtcaaaaatagctgaatgttcccaaaagggacgccggaaggctgactttgcataaacagcaacctttggtcatattttggtttttgaccctcacagccttaaaatcttcgtccccgaggcactgaaaggccgtgtttgtaatttattttaatttaaaaaataattaaagaattataaataagtcgggtaacaccgttttgtcataaatagccgaatgttcccgaaagggactccggaaggctgactttgcaaaaacggccatttttggtcaatttttggtttccgttgatacccgtgcctacttcaccgcagctaccatgatcatagctgtccccactggaatcaaaatctttagttggatcgctaccatgtggggggggggggtcgatacaatacaaaacacccatgttatttgctgtagggttcatctcttgaccggttagctaacgcagccttaaaatcttcgccccgaggtgctgaatggccgtgtttgctaaactaggtctcttatttcaatttgaaaaacaagaaaaagagtcattggtcaggtgaataccgttagaatttttgtcaaaataagtcagcccagttccggtggtgtcttaaaccgttcttgccaagatagccttagattatctttcagttgtcgaaaggctattttcgtaaaagaacgaaaaagtttgggaaatgtcataaaatagtcctccccgacctcaaaattcatgtgaaattgggaaggggccacgtttgcaaaaacaaccatttggttaaaattggcaaattgggaaagcaatttgaccgttcgtttttgagtttgtaattcttttgattagagtatgtgtgttgtttgattttcaagtctgtaggtcgtcttctcgtcaaagtctgttagtttggtcagtttttaaacctttgtaattaagtttgttttattatgaaaatcgaaaaatccaaaaatagtttttatgttgtttacattttatttgcacaaactacgcttgttctgattcgtgcgggggtcacgatacgtaggcaatctccaaagaatatgaccgtaatagtaaaaagaaaaaaaaaagaggaacaaacaaataaagagaaagaaagaaaagagcgaaaaaataaaggcgaaaataaagagaaagagaatgaaagaaaagagcggaaaaacaaaagtgtgaataagagagaaagaaaaagaaaaagaaaagagcgggaagacaagacatggatagagtgagaaaaatggaagaaaggaagaaaggaagaaggaaaagtgaaaggaagcaaagaacgaaatgtcgggatgacgcattcggtcgaacaaatgcataatagaaatgattaactgtataagtgcattcatgccaacgtgcggttatcaaatctgttaaagcctaatcgctaacaaagtggttgtctaaatgtgtgagtctaggcaggtggttagttgattggcaattctggcaactcacccgtacaacacccggtcgaaagataaagtagacatgactggacaggactcggacaccagtattgtggaccctacaaaagaggctgaggtgaccgatgtgggggctatgaaagaagagatgcggaagttgaaagcacaaatggatgtaatgtaccaagcgtggtctcagggacagccggcacctttgtgccctgccaacccctcctacatcccacttctagtgcaggctcaggagccttccactcccaatacatcttcacgcttcctatataacacccagggctatgccactagttcatactcccctccagctccacaacccaaatagaaccctcctccacccataggtccaatctctgtggcacctcctccagccatattacaaaggtcatctagtgaaccactgttctaagcccacgatacccaatattaccctcccgaacccacttttaaggctcttgagccatacacctatacaccccattttgagatcccgaaagaggttgagaaaccggtaaagaatgcggaacaggaggaagtgattcgtaaagtcaaaagcttggagcaatccttcaggaacatgcatggtttaggcagtcaagttagtgttgcatacaaagatttttgccctttcccggatgtccagttgcctgcaagattgaaaatgcccaagtttgatttgtacgagggacatggcaacccggtagcccacctccgtggtttctgcagtaaaatgagaggtgctggtgggaaagatgaactgttgatagcctatttcggtgaaagcttgagtgggtccgcgctggaatggtacacaagacaggatcccggcagatggtatacatgggataacttggcacatgtattcattggaaatttcaatataagcttgagatagtccccgaccgtctttcattgttgaaactggagaaaaagcccggagagagctttagagaatttgatttccgctggagggagcaggcagcgagagttgatcctccgatgagggaaagtgaaatggtagattacttcttgcaaaccttggaaccaacgtactttggtcacttggtaacatcagttggaaagtcgtttaatgaagtggtacatatgagggtgatgattgaggaagggttgaaatccaacaagatcctgagctattccgcacttaaagcaaccacccacgccatcctaagcgttactaggggtgtgctgggaatgatgaagaaagaagaggttgcaacagtcgaagctggggcttggtccagatctagaggtccttcaccatactaccaatccaaaccccaccacccaaattacccatacaccccatatggacctccacatccctactacccaccaccggaatcacatttctctgtttaccatgctcaagcttatacccagccttcggctcatgtgcaatagcgtgcaccggctccccaaaagacatacttacctccacaaaacacatattcacccccaagggcttacaaaaatcctccaggatccggtttccatgggaatcaaaccttccggaatgaaagggtaaagcaccagaaaactttcactccgctgggatagtcatataccagtctttttcgcaaattgaggcagctgggcttgttgaacccagtcgagcctaaagtgccaaatccccttcctcgaaatctggaccagtcagtaagttgtgaatattgttcgggggccccaaggcatgatactaaaaaatgcttggaattgaaaacggatgtgcaaaagctcattgacactaaccgaattgaggttcagacccccgaggcaccaaatatcaatcagagtccgctgtcggctcaccataagtcccatatgattgaattgatgcataagggagaaaagcctaagaaacctttgtagacggtaatgatgatccattctagaaaaaccaatttgaatgaaaagccaactagcgagaaggtgatggttccattgaaagggatagataagaagtcgtcgtcgtcaaatgttcttgggtcattgagtggtacagatggagacgtaggaaaggggttcaaagggatattcactgtggaaaacatgtttgaagcagagggagggtcaaatagggcaaatatgtgcagttcatctgaccacgggcaaaaatgaacgaccggaagtcttggtagtgggtcttgtttttcttaaagctgtgtggattattccagggtctatagtccagatactatgttccgtccgtttaggatgagttaaaaccctgttatcttttccttcaatgaaatgcaattgtctttctttcttcactcttaattctgtttcagtttgtttttcttctccatatagttctttttatgctaatatcaataacataacatgcatgaggaatcctcggctcacttttgaaggctggtcttattctgaagtaataatacaaaaaattgagtgtgataatgagtcggaatatgatgacaattttacccgccttgaacagttgagtttgattaacaaaagagattagtatcagcgcagcatggtcaattgtaccaacaaaaatggcaagagcatacaacaagaaagtttgaagtcggacggttagtgctgagaagtatattgcctcatcaggctgaagcaaaagggaaatttggcctggtaggggccatttgtgttaaccagagtgttgtccagtggcgcattatatctaacaggtatggaaggaaaatgtgtagatatggccaccaactccgatgtggtcaagaggtactctgtatgatttctttattctgattgtacttattttgtatttggcgtattttgaatatggaaatgacgaaggcattttgttctgctatctaaaacacttatcctttgtcaacccttttgagccgtatttattttctttcagaatcaatggcacaattaagaaaatcaagtgccgaagatgagtaaataaaaagaaaagaaggaatgagaggaaagaaaagaagaaagaaaaggaaaagagaaaggaaagaaagaaaagaagaagaaaaagaaagaaggaaaaaagaaaagaaaaggagaactgaaaaataaaagaagaaaaaggaaagaaaaacacaaaaaacaaaagtaatttctatggcgtgaactacgtttgacttgatcccgaaagggtacgtaggcagccttcttttgaggttcagtcataacaaaaaaaaatccaaaagtccccaagcaagaaattgaggcagaagtgatttattgtgagaaatcggattccaaaagttgtaattttaacccattttgaagttgttcttgagccttttatacccttgtttctaactcatccaaatgcctacattacagtccaaagaaagaccttctgatcagtttttgagaaatgctaagtcaagcaggtagaggtaagtcatgacagggcaacactctggttcaagcaagaaaaacaaaagataaaatgagagagtcttattggtaaaaacactcacgggcaccgtaaggcgatgagagttgagagaaaataaaatgagagagacttagtggaaaaatccctcgcgggcaccttgaggcgaaagtgagttgagtaatggtcaattaagaaaggtctgttggtggaaaactgtttcgtggcaccgcaagataaacaaggttaaggtttgggtaaggtaatcgagtgatggaagttctgagcaatgaagtacgacaactaaaaactggttaattggatcggttgggccggttagtccgaaatgcatgtcatgatcatttgtgccagctattccggtcagaaaagtttcttttctttttccgtttaacagtcatctggttttggattcttcttatccttaactcataaaatcattgcatttcagaaccaatgtcatgatcattggttctgagcaatgaagtacggcaactaaaaactggttaattggatcggttgggccggttagtccgaaatgcatgtcatgatcattggtgccagctattccggtcagaaaagtttcttttctttttccttttaacagtcatctggttttggattcttcttatccttaactcataaaatcattgcatttcattctcttttgggggttttgtttgtctaagatgttccaatgttagttttgttcatgtgcaaaggggaaagaatttcaaagcccactaccagcttccgaaaatggtaaagcataatatggttcgagcatgtcaacaacaatatgatataaagtggaataggtgaagttgccggaagtttcattggtggaataattgggaaatgttgcgagaaatgtaaaggttcaggcaaaagggtcagaaaagtgaaataccagcacgggtacaaaagcattcaggttgtttggggaatttgaaagtcggtcaaaaagtcaagcggttcagaggaagtcagtcaacaaaaaacaaggcagtggaaggattttcaccaagaatgccatcagctaaccaccattttaaactaacgaaattttctttgattgaaacaggggcagaaaagttggttgttcgggaggaattctctgtgaaggaaaaacaagctgtaattaggtttgaccgcaagagtggtatggttaaaatacaagataatgaagagtaacatggggaaatgtaagttagtctcaaagaaaattcaagtagaagttgtcaggaccttcctggataataggatgtagtcttataatccgtatagataacatgatgcagtaataccttaggttcataattgttaggagtcgtcaggatcttcctgaataataggatgtagttcaaaacctggtaaatggcataatgtagtaagagcaatacttttagaaaatatcaattaggttcataatggttaggagttgtcaggacctccctggataataagacttagctttcaaattgttagtaatagttggtatatgattcagtaacactcacccctggacccagttttccaaactggggcagaagattttcctcattttcgtatgttttgttgaagtcaggagctcgcctgaagaaagaggtgatgcaattcaaatttttagttttcaatcaatttctttgtctattttgaagtcaggatcccgcctgtataacagaggtatttcaagtcaagttttagtcaaattcttattaatatcaggtaacatgtacctagtttccaaactggggcagaaagatttctttattttgtctatttttgtgaagtcaggagcccgcctggataacagaggaataaattcaatttcaagttcagcaatcaggatcccatctggataacaaagggatacattcaatttcaagttcggcagtcaggagcccgccgatagaacagaggtattacaattcaagttttagttttaattcttattaatgtccaataacatgtacctagttttccaaactgggcaaaaagttttctttgtttggtttattttgtgaagtcaggagccccccctggataacagaggagtacatttcaagtttgaagtaaggagcccgcctggagaatataggaatacagttcgagttttgaagttaggagcccgcctggagaatagaggtattacaattcaagttttagtttttaaattctcatccagtaacatgtacctagttttcaaactggagcagaaagttttctttgttgtgtctgttttgtgaagtcaggagcctgcctggataacagatgaatacattcgatttcaattttaacaatcaggagcccgcctagacaacagaggaatacattcaagttgaagttcaacagtcaggagcccgcctgaataaaagaggagatacattcaagttcagcagtttggagaaaggaaaacatctcagatcacaagacaacaaggcaacatggaacacaagatcaagtttggagattttagataggacttttgtaattcatagttcatagcttaggatagctttttacttttgacatggtgtaataaggaaggtcagcgagcagtagcagcagcaatctcagtgagatcacagctcctggtagtcccagctaccagacactcccgaactacactgaccagattcctgtttagcccaggatatgtaggcaatcgctgaagcacagtgcggtcaaacttttcaaaaatgcttcacacggaatatgcgaacgggcaaaaagccctcgtttccgctcacttatctttgcatgaaaactcttcatgttttcgagcaaagagaggcagctgtgagcacgtgatttttgccctaagccaattattcccaaaaattcaaataaaataatttttttattttgaaagtttttgaattctatggtaattgtttgcatttttatttgcgcattttattcatacgaaaatacaaaaaatatatgtggcatttgtgtaggatttaattcaatatttttagagttaattggtaggttttttttttttttggtaaaatccactaagctgagcgcttagggctgacttttatatatatatataagcaaaaacaaattaaattaaaatacatttactttgtccggaggcctaatgaaatgaaaagcataatctttgagaattacagataacctatttgatagaccgacaaatatatcacgaaattgtgaagtatttgcaactatcattccaataaaatctatccgtagtctctccatttgggtccttgtgaatgtagcagtacatttccaaatcccactcctctgcgttgttttttttgcgatctcccatttgtcttttcttttattgtttgtcctggataatcttttgtgcataataatccacagaatccacaaaacctctgattgccaatagatgacatctatttctgtttcttctttgtcacacacttccttttgatttgtggtcgagcagatacgatccctgtccagtgcattgcccagctcttcattgcatatactccaacacgtcgagcttagcttgttgacgtcaaagtatgaggttagtggtgagcggcatgttgtgtagcatattgcttccagagttccacttttgagtgcttctatgatcaacaagccacggccaagttgcaagactatgcactgatcattcaatctccatacgtgccagctttgaatcccaactgatgtccagtattctgatcgatggcacatagtggttacacaagatgtcagtctatctaagctgacttgcatttgaaccctatcgcgtgctagtcttctactgtatatcatgttttcttctttaagggaatgagtataaaatactaataccaccctttgaagttgaaattcacgatacaacactactcccaactggttccctacaaaaaagaagccaaagttagtggtacgactgtaagttttgttctgttccatgaagccttgagcaagccaattcttgctacctttttccatctgttggaactgaaattttgttcccagcactaactccatctatctcagaccatcccttgggcattccagcgtagcttcatctttcttcacatctggatggcagcctatcagtgtacgactacacttccaccttgtagacttctcttcttctaatttcttgctacctttactcttaagtagggacattgcaatttatcgttattcactatctttctaccttgtatgtccaattcccagaagctacgtgccaccacagttcctatatccagtgcataattggctaaatgatcagccaaacaatttccctctctgagtgtgtgcttcacaatgacattagctcttgccatcagttgttgaatgtcctacacctgtgcgtatatactccagggtattttccattctccatgaagaatattcttcaacatcaaggagtcggtgtgaagttctataagcatgtattcattatcaatacagtatctcattgcttctaggattgcttgtgcttcagcttcagtgtttgtcccctcctgcacctctctcccatatccatgtattatgtcacctttctcattccttaagacataaccaattgcacttcgaccaggattccccctagacgctccatctgtattcaccttgatccaacctgggctaggacactcccacaatactttagtatattgcagttgtggcagatatgattccatcatatttagcaaatctggccatctgtgtgggactctttgaattgatggttttttgtatttcactaatgactgcatagaggtagatatctggtagataactctattaatagtcacagattccccatgcttataactatttctgcacttccatagttcccaaacaatcacagctggtagtgcttgtaagataggcttcaatctgggaatcacttctacagtccaacacttggttatagcctgatggagtgtgattccatcaatatttattcctgcatgacctagaaaatatttccataccttagtggctgcatatgaagtgaagaaaagatgttgccttgtttcctcctgtggctcagaacaacaccaacatttcgaggccatttggtatcctactcttctgagaaagtcgtctaaaggtagtttatttttccacaacttccacataaagaaggagattttgaaaggtaatccctgcacccaaatgaatctgtatgcattacctggcatgtttcttttcctcacataatcccaagatgacttcacactgaattctcctcgtgtttccaacatccacagtggtttatcaagagcatcatgcacaactggaggctttatatgcatgagaatgtgatttgccaaatcttctggtagtatttccctgagcttgacctcatcccattggtcattcattacaacatcatttatgttctgtatggattcatcacatagaaattcaggtggagtaacaaaatataatgcacccatacctgtccagttttcaaaccaaaagagtgcagatcccatattaggcttccacaaaatttgatgttcaatgaggtctctacactctaacatctttttccatatgtgtgagccacctttccaaggaaaaatcataggattcagtttcttgcagtatttctgactcataaacgcactccataagcttggttttgttctaaaattccaccatatcttacagaacaatgcgatggatacatcatgaagggatctaaaaccaacacccccttcctcacaaggtaagcacaacttattccatgatgcccaatgtctatttgacacacctacagtgttgctccagaagagctgagcaaatattttatgtaatttgttaatcacagaaggaggtggattcactgatgccaacaaatgaattggcatggtctggagcacatgagaaatcaatacagcccttcctcctatagatagcagcttacctttccaattctgtaacttatccagcactttattcatgaggtcttgataataatccattcttcttcttgcatagaaaattggacacccaaggtaagtaagagggaattcctgtttgttaaaacctgttattctctgcaccatagacactacttcctctcctgctgaatggtgaagataaatggcacttttgctcttgttaataagctgcccagaagctgcttcataacctgttaaaacctccataatcagccttagcgatgttgcgtcagaggatgaaaaaatgataatgtcatctgcgtacgaaaggtggttaatctttgggctccattttggcaagccaaaaccacagaaattcaaatttctatgaagggcattcatccctcttgacaaagcttcagctgccaaaataaatagagacggcgatataggatctccttattttacccctcttgttgacttaaagaaaccatatggctggccatttaacaaaacagaataccagttgtttgctacaatgccatataccaagccaataaaaatttctccaaacccaatcttccgaagtacctttgtcaggaacaaccatgacaatcgatcgtatgccttagccatatctagcttgatcacaacgtttggcccagcttttgtcctcaaccttatatctgtaatgatctcctgggttaataagacatttttaacaatactccgaccttttacaaagccagcctgttcctcagagactatgtgtggaagtaacactgccaacctttcgtgaacaactctagaaaatatcttgttaacaaaattgctaagactaataggtcgcatgtctgaaaaagtgatcacttctttcttttttggcaggagcaccagatttgtatgagttacatatctgggcaactcatggccattgaaaaatgcctgcaccatagatacaatatcatctccaattatgtcccaacatgtttgaaagaaacaacccgtgaagccatctggaccccctgcactgtcgccatttaatccaaacactgcatgcctgacttcatccttcgttgattgcttaattagctcaatattctgggcataatccaccagatttggtacatgttgaagaatatcaaaggatgaagtagttgtttcctcctgaagttggtctttgaagaacctcactgtttcatttgccatgtcagtgttactttctaaccaaatgccattagtatcttgtatttgtttcagctgtaatcgtcttctcctaccattaacctgagcatgaaagagcttcgtgtttctgtcaccctcctgaaaccatgtcatcccggatttttgcctccaaaattcttcctctaatgccaaatatcgaataagctatgcttgcaccttctgtaacctttctctgtttcgatacgtagggaacctttcaaactgtgcttcatgtacaagaactacctcttcaagactagcaatcttttgaaataagtcaccatatgttgccctgctccatattgatagtgcttttttcagttttttcaacttatgattgaaaatatagaaaggatcaccaatgaagtccgctgtccagttttgaataaccacttccttgaatgttatatgcctgcaccagaaattcaaaaacttgaaagcttttttgacaggtgcaacatcagggttaaagttcagaatcaatggactatgatccgagcctgttttgggcaagtgtgtcacttctatattaggccatttctgttgtaactccgaattagctaaacatctgtccaatcttttgaaaatacagtcatcttctcctctcccattccaccatgtatacacactacctttgaagcccaagtcagttaagttacatgtgtttatgcaatgcctaaaatcattcatttcatttaatgtcacaggcagtccaccaaacttctcatcctcatccaatatgaaattaaaatccccacccacaagccaaggtaatgtcatattagaagccagattgaataaactgtcccataattctatccgctccatagagtcacattttgcatatacaaatgtaaccataatagacagctgtgaatccagatttgtgagcttcaaagtcaactgttgagtcgagtcatatattatttccaccccatgataatcatccacaaatacccaaattttgttagacacatttgaaaatgcctgcaacattccaattcttcttctatatctttccagctttttcttcttttgttttggttccatgatacctatgaatttaaacaggtactgtttttgcatagtaataagtctctcaaaggcctgcatagtcttcacagacctcacattccagaagatggcattcattttaatgttgggatttaggttgggtccttcttgtttgaacccctgatactacactttgtaggcttggattgctgtctttttgctgcttcttatttcctttcccaacagattttcctctcttgggtgaaatatctgcttgtctggcagcatgttggaagttctgagatgtagactctgcatctaagtcttttcctctgatcaccatattatcttcatttccccttttctccaatggatcaacaatttggttctttgtggaatcagcttttgttacaacagtagaatcgttggagttcacttcattcttcttcaaatgaacctgcttgtctatattagcaactgtattattctgcaactgtataagttgtctgcatgtatccttaactgtttctcctatagctatatcattgccctttctactgatgtctcctgtatgtatattaggctcgactggaggccgttcaccatctggattagaggttggaattttgtgtatccctccaagttctatcaacatggaaattccttcattgtcctctattttttcttgcactttaattggctttccattatttctttgttgtgtcttatcttgtgcctcatgtgatgcttcttttccttccatggcaccttcaggtaagtcaccctcctctgaatcttcttcaatttgttcctcccaaagcttgtctccattgagttgcactcttgtatcattcttggttatcccatctggtgcatcaaattgcattggttgtgatggcacatctgtgaccatgttttccccgaaggtgctattcacccatgctgctgttgaattatttttaatccccttctttcttttatctttttatttcgcaattggatcctgacaatctccagttgacttaggagagaaaacaactgcatttggattaagcctcttatctggaacacctgcagggctgcttacaatattgctatcctcctcgaccatatggttttggtgttgatcctcagcatcctgatcttccaatattgcaaacttgttagttgttttgatatgctgattatgaacctcatcctcaaggtttccttttgccattacatttccagatgcttgctgctcattgattgttactaggaccatttcctttcctacaatattgtgcatctgttggttactaatgtttacgtgactctgctgtccatccttggtatccacaggagcaatttccttgtccccttgtccttgtacttctacctgcttattaccattcccctgcaccccttgcacattgtctttgccttgcatttgctgcccattagtttgattctctggcacaatttcttttcctgtcccactttaattctcatttttcctcactcgattgtctctcacctcctgccattgtccctttgtattgccattcgacttagcaagagcttttccattagatggtaacactgcaggctgattagcagcctttttaccattaatcgttaagtcttgatttgtatctttcttttcaaaatagagttccggatgtaatctccaacattctaacaagtcgtgaccctgtaatttgcactccttgcagtatttaggtaacatatcgtatttgatatttacccattcttctcttgtttccctagtcgactcattaagaatatccatttttaccttctttggatggtccgctaacaaatcaaccagaactttgaccctcgcgaactaggtcgagttttgtttactattgcagaatcaagttgaattggttttccaatagctgctgcaagcgaaaataagcattccttcacaaagtaagttggtaacagacctgggaatgaaatccacgccatagcctttggggtctcctcgtctgctttgaatttgacatcatatattagtggacgaagctaatatttttgcccagacctatctgtaacatactgagctcctttcgacacgtaatcaacgaaatcttgccataaagtcatccttatgagaatatacctgtcccttaatactccaattttgcattcacctttgattccacattgtagcggcacgatccgacgaatttcattaatatctggccatccataagaaaattttgcgaccatggcaaattgaagttcttcaattacattcatcctctctacttcagcctccgtaaacttcacaaccggataaccatttatcatagctggtgggcgaaaatatattggttcaattgttaaaatcttcccattcaaggtcatcgaagcaggattcatgatttttgaataatcgagtggcggttggatattgtttggtgttgtttgagttatgttaggtgtagcttggggaggcagccccaccactggaagtggtgggccaccggccggagaatccattgactaccttcagctcaatgaaacagtgtaaccaagcagagcaatctaaatgtagtagtgagaattgaccacagagaacagcccttcagctcaatgtaacagtgcaaatgtagagcaaactaatactccaatctgcagctcaatgtaacagtgcagtgcaaggcgttaatttttcgatggctataacagagtcaatcgaatatggactaaaggtttgaaatatggtggaaaaacgaaatttgggaattaagattgaagttagaaactaattacaggaaggattaaacacattaaacattgaaatctctaactttctctctctagttctagagagaaggtagagaaacggctagggttcactaaatcaattggtaggttgaaattgtttacataggaagaaaatatcaaaaatggtttttttgcatttttaccttaaaattagtatcagtttgcatttttaggaataagttagaaagtttaattttttgtgttaatttgtttgaaagttttattttagtactttttttatatatataagatcaaaaattcataaaaaactaataaacaaaataaaatttaagatgcaataaagaaaaccatttggaaaagaaaggaaaaagaagaaacaaaaggaaaaaaacgatttgggccgtctgtgcccaaatcttcccaggcccaaaatcagtctgccccacacccggctagcccaacccaactcctcacccggtccaaatcccctcaaccaaaaacgacgtcgttttgccatcactcaatcacaaccattgaatcaccttaatctaatggcccataacttctgtcgtttaattatataagtgtcggatggaattaattaaatcaaaaagacaaggcagtcttcctcgtaccatctcttagtttgtcggaaccctaccgccagcgaacggaaccacctccaatccatgtcaaaataacacccaagcttcccctcatcttccccatttcaaatccacagtccttttctttcaaaccttaccagaagtcctcgaatattccttggaagattttctggccaaaacgcaaagtatgccaaatagtcccaaatttacaccatgtgaccgcctaagtttcctctacccaacccccatagtggcacctctcgaatctacctagaatttctcaaatatcaaatcaaaactttttggccaaaaccctaattcataatttttatgattcggaccgtaacacctttaatcatgtgttttcttatgaaaatacctgattagggatgttacatgtcagaaattccgggagatttgggctcattaattgctggccgaaattccttgtccattagtaagttttctagtttcttttattatttcagtttttctttctgtttagttgcatgtgtaagttctagaacctttgtttgattttaattttagttggcttgaacttcataattagttagttaaattgtcagattagttcgttccattaattgattatttgtctgaatagtttgattgttaggtattcaaatagtcaattgtcttagttgtatttcctttatataatctgctcttattgttaggtttcatttatatttaggctgttttgaaagtgattagtcctcatctaactgaatgggttttggtaaaagacgatcagtattaattagtgttcaagggcattctaggtaattggtgagtacaagaataacttagaataccctaagagtttctagacaggggtctttaagtaatttgtgaaaaatagtaatgttttcttgtgtgtcaagttagaagtaccggggggtaaaaggtaattaaatcagggactgaattgaaaatagggagttgttttttgcctataaataggcattgcatgtgccttgtgaagggggtcttctctttagccatttttgagctcactgaaacacttttctcattcgaagaagaccatcttaatttcagaaaaccaaaaaaaaaacaaaattcaaaaatcaaaaatggcaattactgtttcattgagatcttagtttaagttcaagtcctttggagtgtttgattgttgattctgatagctactggtcgatttcaaggcataattgattgctggaattttctgagttgttttgaggctattcgagtttgagttgtggtgttatccgtgattctaaaaacattcctgggtttgaggcatttcctgggttgttttactttactactggagttcatttaggcactcaaattaaacgaaattagttgattgatgctgctgttgcactgattcgctgacctccactttcttcttctttgaatcctcattttccaggcacttgttcgaaactggctagtgtatgtgtttgaattaaagctagaatgaaatggcccttatggaatttcatgtatttgaattgttagtagagtaacggatctgtataaacttagtttggtttaatttatataactgggctaatgaaattgcttgctttggtttagtttgtataattggacttataaaactgttataatagtgccttcacttcgttttaatgtgatataactcttgagttagacctcttagctaatctgtggtgtgtaaaaagtagttgatggctgttgttgctttgatactgttgggtaataaatcattctaggattcaaatttatatttgtttaagggtaataactatgctaattagacgccactttactttgaaggctagtttgaaatttgcaaagcatgattcataattagtttaatatatccattgttttgattaaactattagattaattttgataagtatttgagtctgtttggttatgtgccactttagttaaaataattaggccttcagcatataataaaatagagggtcaattcggtgggggttggatttgggatttggatgaattattgtgctaaaagggaccatgctagttcagggactcgatccccggccatgactgaggctattccgtcaagcccagattgggcctgcctcaggcccacgcttttgactgtcaaaaggtccagtctggtctgtacattggattgatagaaccaatcttgaaatagctaggttagtgtgataatgtttacatagccacttgaggtggtttccgttaaccaattaactaaggttttatttttccttttatttgacgcgttaagtagatgatagtagttgcccttaagtttgaatttaaaacagtaagatgagcctcgccaaataaaaacacaaatacggggccctcaataattgttctataaatttacttagaatttgggagggccgtttggtgaattttacgaccttccccaaaaataataatacgttagaatctttaggcacgatttaattaatttactttattaaactagggtgcacattgatgcggcccaaatccaaatctcgacaaagtcagaatgtgttgacaaccacgggtgcattgattgcgacgtggttcgaaatgcgttttcacgacgtcacaattcttttaaaataaataactataaaaagcggtttatgaataaaaggtatataagctagcatgtcttcaaatcaggtaaaatcaaatacaatagttgggcgaccttgctagaaccacggaatccgggaatgcctaacaccttctcccaggttaacacaattccttatccggatttctggttcacgaactgttaatagagtcatatttttcctcggttcgggagtcaaccggtgacttgggacaccattaatatcccaagtggcgactctgaataattaataactaaatcccattctgattgtcctttaagtggaaaaacttctttatgcccttgtgggtgtagtgaaaaggaggtgtgacagaagtgcatgtgcctttcttttgtcatcaggcacggttccgtgctgtaaaaaaagtaacaatttcgtttcttcaatcccatgttaaatgattaaatttaccttgttcttatcaggttcgagaatagaatgaaataaatgtacgactgaagcgtcagtatcgtttgctacgtctgctgcagatgcgagattagctaaagcatctgcctccacattctcacctcttgggatctgcattacctttcaagtgtggaattgctttattagttctcgtaccttttcgagatattcttgcattcgtgtttccctatcatatcagtatgggaccaagcaaaacagtcaacattagcttttaaaaattcaatcaacctacctcacatgtctgaacttaaattggctccatcataaaccttccgttcatgccattgttcgaacaatatcacagcttccaactcttcaattgttgttttaatattttcattctcttcagtttcttgaattgtatcaggtctctagtctaaatctgtcttttcttgttcagttgaggtttgaacagtgattccctcaacttcattcacggtgctcgtatctgttacagcattaatactcctagttctatgttgttctccacgaatttggcagatcccccttggtgatgggaattttatgacttgatgtagagttgataggataacatccatatcatggatcgacgacctccccatgattatattgtaagccatctccatatctactacctgaaatttggtttttttcacaacaccctctgcaaaagttgttagtattaccttacctttagttaccacaccggagttatcgaactcggataaagtatgcgcctttagaatcattttatcttcagcttgcatctcacgtaacacccttaataggatgatgtttacagaactccctagatcaatcaaaactcgtttcacattagtatcatgtacaagtaaagatattaccagtgcgtcattgtggggagtgatcactcattctatatctgcatcatcaaaagtgatactttcattctctaaaatctgccgcactcgcttttcgtgtgtgattgttagtttgaaaactttgtttgaagctgtatatgttactccatagatatcctcacctccactgataacattaacagttctcttgggtgatggtggttttggtggatcttgcctatttttcatatagtcttgcttacctttctcactaaacaactcagtaagatacccctactttaagagatagtccaattttctttgtaagaatttgcattctggcgttttatgtccatgatcattgtggaacttgcaccaatggtctggattgcgcctgtttggatttgaccgcatctccttcggccaccgtaccttgtctcccatactcctcaaaacagccactagtttggaagtacttacattgaaatcatagccaccgaaccttgcctttagatttctttcatcatctcgtggctcttcagtgtttcgatcatttttgaacctcgataaagaactggtctccctatttctggacctttgatcataccgttgattatcctgttttgaccgtgagtctatacctgcgggtcctatatatggatcatatctattcttacctgatcttttttcggtctctgacctcctggaactgctcctttcttcacaatgaaactggggaacaatatcttcttcaattcgcagcttcgtactgtacctgttataaacatcattccaagtagttgtaggaaattctcgacgactttccttaagcattctcgtggcttctgaacttttgtcatttaagttgcttgcaaaagctattgcagcgcagttatcagggacgcgaggcaaagtcattctttcacgttagaatctatcaacaaagtccctgagcaactcggagtccccttgtttgattttgaaaatatcctccattcttttctcaactttttgagctcccgagtgtgctttgataaaagaatctgcaagctcagcaaaagaatttatagagttttcaggtaaaagggaataccaggttaatgcacccttgatgagtgtttctccaaatttcttgaccaatactgattcaatttcttgtttggtcaagtcattgcctttcatgcctgttgtaaatgcagtcacgtggtcatgtagatctgttgtactatcatattttgggatgtcaagcattttgaactttttaggaattggaaggggagcatcacttggcttccaaggttgttgtgaatatttgtcgatatccactcctttgatcacaggtggaactccagggatttgctctatgcgctcattttgttccttaagctatttctgcagggttagtactaaattttgccaatgagaagtagttgaattacctggtttaccttcatgtgattcacttggtgcatttccggaattaactaatccagaacggggattttccaacatgttgtcattcggcgttgacggtgcaacagacaatcgactgattaaagcttccaaagctttgtcaactggtgcatgaattattttctgtagaagctagtatctcccttcaactcttccatcaacatgtttagatagatcattaggagtactttctcgagatccacgtggggaaccttgaggggaaagatcatcacgttgatctccatccacttgatgtgtttgattttcgagaatattttcgttgttgtttgacatgatgataacaaaaggtagaatataattaaaaaagaataaattatcagattcccaggtaacagaaacaatttgtttaaccaaaaatctgagtctttggtcaaagctagaaataaagagaaatttgggttgctgataatcaggaaacgaaaataatagaagacttttgagaataataataaagcaataagtagttttgtatttcagtgtaatctcaatgatattttgtgtctatagatgttgagtctttctccttttatagttgattctaggagaatgtgtaatgtctttgtcttaatgaggcaattgtgagcaataaatgacattaaaagagttacacaatcattcctatttaatataaattctctaacatatttgatatttaatgttgcatttagactcttttgcgttatcagattcgtatcttcaaccccttccgattttcggtttttaaatgactcgaataagtacgagactcgtgccatttgaatagcaactcatacctaagttgctttctttttctcttatctgttgtcgcccgtgcctcttggctaattattgtgttttgaccttttgaccagtccacgtgttatgacatatcatcttcaatatacagtctcagttttttcacaatacagaaatatgaaatatattgatacgttttatttttacttaataaaagaagttgaatgaggaaacgtgcattggtatactacaaaactatatgcatcaacgactctattctagcgctcaagacatgctccagaatctacatcagtcagagctagtattccttaaataataaattttccttggcaaagcatgcttgaaaactttgagcatttataagcttgtttaacatatatattcagcgattcttcaagtattatgtggtccaacttcatctgttgtataaaattttatttcttcaagtattatgtggtccaacttcatctgttgtataaaattttatttcttgaagctaataattttttgtcacatttcctagtagatgtaagtatcatctgcacacctatatactttcaagaagtacaagtattccaatgttgctaattaggcattatttccattaccaatgatacctgtaacttttgttcatcctctattttctccagtaaacttcttagaagtagcaaatgaattacagaccatactgtattctaagatatccacacacaatccaaagtagaattctaggaacacatacaaaatctcttattagaacaatcaaagaaaaaatgaattacctataagagctatttgatcaatgcactttatataatgcaattaccatatttttaaacgcatacccatactaagttcttagtactcatattatttatacattgaatcaaggacaacataaatcataccggttaaaactaacacaaaacatcaattcaatggcataagcatcaagtttgttgttgtaacgacccgaccggctgtttcataggttattgctccattttttcatttctacttctttatgtgtttttcagttgtattttctcatatcgtgttggttgtttttgttttgaagtggttttgtataggagtgagacacttagtctttttgagtaaacttaagttgaaaaagtcaaccaaatgttggcttatgggtagaaggtttcggatgtgaattttgatggttcggatagctttgttaggttaattgagacttaggagcgagatcggaatgtattttggaggtcgtggtagaattagacttaaattggtgaaattaaaaatttggcgtttttcggttggcagtgaaaatcttgatatcggggtcggattggaattttggaaactgaagtaggtccatttgtcaattgggatatgtgtgcaaaatttcaggtaattcgaatgaggtttgataggtttttgcatcgtttgctgaattcggaagtttgaaaatccttaggcttgaatccgatggtgatttgatgttttgatgttattttgagtgttactaaggttggaacaagtttgaatgacgttatgggatatgttgtcatgtttgaatgacgttatgggatatgttgtcatgttcgggtggttaacagatcaattcttggcttttgaagttggcagatttctgatattttgttgcagagaattccttcttcgcattcgcgagaaggctctcgcgttcgcaaagggttaatgacaggggaaaacaatttgttcttcgcattctcaatgtaggtcccatgttcgtgaatgtgtatgagtttaaggctacgcgttcgcagagggtcgagctaagtgatcttcgcgttcacgagtgggcccttgcattcgcgagtgggccatcgcgttcgcaaagaagggaatttggtctgaggcaatttgtgctttgcgaatgcgagggagctaccgcgttcgtgaagaagaaaacacccctacaaaatctttaagttcaaaaacgagggttttggtccataatttcaaaattcattagagagctcgagagaaggtgattttggacaaaatgtttagaggattgattggggtaagagctcttcactcaaatttggttaaatcccatgattatgtcttgattcttatcatttagtctggtaatttagggtgaaaattgaggaaaatggaagaggatttggagagttgattttagggatttggatggccatttgctgccggattttggtgaatttgatatgggtagactcgtaaacaaatgggttttccagttttttgcttttatcgaattttgagacgtgggtccggaggccgggtttgagaaaattttaggaattttgagttaatttgattattttcgcttaggatttgttcctttagcgtatattgattataatgtactaattttggttagattcggagcatttagaggccgattcaagaggcaaaggcatcacatgatagagtttggaccgatttgaggtaagtaatgattgtaaatgttgtcctgagggtatgaaaccccgaatttcactactttgaggtgacgcacatgctggatggcgagcttaggggcgtacaccattggaaattttgaattggtctgtcccgtacgactattaagtcgtgtatttgattgaaaactatttgatactattgtgttttttaaagtattactatattgtgggctgaatgccatatttgggcttcgtgccaactgtttggacccttaggggctttttactacccttaggtgccatcatgactaggtcaattttagggtcgtgacaggttggtatcagagcctaggttacataggtctcacgactcatgaggaggtttaatagagtctcacgagtcggtacagagacttctgtacttatcctcgggaggctgcataacctttaggcaaaacttaacattcttgaattcttatcgtgagattctattgattctagtaactaaacttctgttattcttttctctcacagatggtgaggtcacagatggtgaggacacgtgctaccggtcaggataaacgattactagtccctccaattgggccactagaggtcgaggacgcggtcgaggccctggtagggttaggggtgtagcccgcaaaacagctagggcaacacttgcatatccaccagccgtcccaattcaggatcaggtcccagttgtggatactccagcagtacccgcttaggaaccggtagtgcctattgtcatcccaggactttaggaggccctagcctagattttttcagtgtgcattggcttggctcaggcagtatcaattactatggccgcagctacttctcataccgggggtggaactcagaatcccgccgttcgcacacctgagcaggtcatgcagatacttcagacaccgggggcacttccagcccagccggttgtagctgctggggactatatagctcctgttgtgctagaggacgagcatcgcagattggagaggtttggtagacttcaacctccgtcatttagtagtgctaagggtgaggatgcacagggcttcttggaaatgtgctagatgatgctatggaccgcatgtattctagagaccagtggggtctaattcactagtttccagttctggggggctgcactcagttggtggtatgcttacgagaggtgtaggccggttggcgtaacgcccctttcttggcagcaattctacattctcttcctggagaagtttgtacctaagtctcaccgagagcatttgtgcaggcagttcgagcagcttcgccagggcgataggtctattacacaatatgagatgcggttctacgagttgtcttgtcatgcggtctgattggttcccacagaccggaagaggatcatgaggtttatagatggcctcagtttttcagctttggttgctcatgaccagagagagggtatccggtgctacctttgatgagattgttcacatagctcgagagattgagatgtttcgtggtcagtagagggttgagagggaggctaagaggcctcgtggtctgggaggattcagtggtactcctcatgggggtcattatcagcacagcagaggtcgtccatttaggtatgctcagtaagctcacccaggttatcatgggaaatcattgggccatggttttcatagttctcatcagggccattcatatcttagtgcccttccagcccagagtttcgtgctctatccgtttaaggctctttcatgccaggttcttctacttgtcatcacggtgctaaggattcccttcagtccccgtcttcagcaccaaggggttgttatgagtatggagagtttgggcatatgtggagacagtgtcctcgtcgtcttgggagttcgacttagcagaagactcagccatcgacatcagcaccagttactttaccatccagccagccagctaggggtgtaagacagtcaactaggggtctccccagagggggaagccgatcaggtggtggtctggcccgtttctttgcactcccagctagacctgatgctattgctttagatactatgattgcagatattgtcttagttttccccagagatacctctgtgttatttcatcttggttcaactttttcatatgtgttatcatattttgctcgttatatggatacgccccgtgagtatcttgtttcatctattcgtgtatctactccggtgggtgacaatattgttgtggactgtatatatcgggtgtgtgtggtgactactgggggtttggagaccggagtggaccttctgttgctttatatggtcgattttgatatgatattgggcatggaatggttatctccatatcatgctattttggactgtcatgttaagacagtgacgttacctatgtcgggtgtgccacagcttgagtggcggggttcgacctatttttttcccagtagggtgatttcagttttgaaggcccagtagatggttgggaagggttgtctttcttacttggctttcgtgagggatgtttgtgcaaagacttctaccattgattcaactcgatagtgagggactttacgaatgtatttcctatagtcctttcgggcatgccatcagacatagatattgactttggtatcaatttactactatgaactcagcccctttctattctaccatatcgtatggaaccagcggagttgaaaaagttaaggagcaacttcagaaactccttgataagggatttattcggcctagtgtgttgccatgagatgcgccttttctatttatgaagaagaagggtggcactatgaggatgtgcattgattataggctgttaaacaaggtcacaatcaagaaaaagtatcatttgccttgtattgatgatttatttgaccgcctttagggagtgagggtgttctccaagattgatctcggtcggggtatcaccagttgatgatcggggactcggatattcttaagatagctttcaagacccaatatggtcattatgatttccttgtgatgtcttttgggctgaccaatgtcccagcagtgttcatgcatttgatgaacagtgtgttttggccttatagtgattaatttgtcattttattcattgatgatattctggtactctcacgtagtcaggaggagcatgcagagcatttgagagtggtattgcagcgattgagggaggagaagctttatgcaagttctccaagtgtgagttttggctcagttaagtggctttctaggcgcacgtaatgtccagcgagggcattcaggttgatccaaagaagatagaggcggtccacagttggcccaggacgtcctcaaccacagagattcatagctttcttggtttggcggcttattaccatcggttcattcagggattttcatctattgcatcacccttaaccaaattgactcaaaaaagtgctccattcaagaggtcggatgagtgtgaggggggctgtcagaagctcaagactgccttgaccacaactccagtgttagtttttccattagcttcaggttcatatgtagtgtattgtgatgcttcgagagttcaagccccatgagaagggtagagtaattacttctgcttctcgtcagttcaagccccatgagaagaactaccttgttcatgatttggagttcgcttccattgttcacttgttaaagatgtggaggcattatctgcatggtgtgtcttgtgaggtgtttactgatcatcgtagcctccagctcttattcaagcaaaagtatctcaatttgaggcagcagagatggttggagctgctaaaggactatggtatcactatcttgtaccatccgggtaaggctaatatggtggccaatgctttgagtatgaaggcggtgagtatgggcagtttgacatatgaatatattggagcccagtcgggtcttagcttgtgtgttttctcggtcttccttgtccgatcgcatcagagagcgccagtatgataatcctcatttgcttgtccttaaggatagagttcagcacaacgatgctagagatgtgactattggtgatgatggggtgttgaggatgcagggccgaatatgtgtgaccaatatagacgggctttgggagttgattatagaggaggcccatagctcgcgatatttcatccattcttgtgccacgaagatgtatcaggatttgagatagcattattggtagaggagaatgaaggacactgtgggatttgtagctcgatgtttcaactgtgagcatgtgaaatatgagcatcagagatcgggtggcttgattcagcggttagatattccggagttgaagtgggagcgtattaccatggattttgtagttggactcccacggactttgaagaagttcgatgctatttgggtgattatggatcatctgaccaagtatgcacacttcgttcatgtgtgtactacctattctttagagcagttagcagagatttatatccgagagattgttcgcttgcatggtatcccaatttccatcatttcagatagaggtactcagttcactttgtagttttggagggccgtgcagtgagagttgtgtactcaggtggagtttagcacatcttttcaccctcatatggacgggcagtcctagcgcactattcagatattggaggacatgttgcgcgattgagtcatttattttggtggtttatgggataagtttctaccgctcgtggagtttgcatataacaacagttatcggtcaagtattcatatgactccatataaggctttatatgggagacagtgtagatctccagttggttggtttgagccaggtgaggctagacttttgggtgtagatttggtgcagaaaatactttggacaaggtgaaggtgattcaggagcggcttcgtacagcgcaatcaagacaaaagagttatgctgacatgaaggttcgtgatgtgtcctacatggttggggagaaggtttcacccatgaagggtgttatgagatttgggcaaaagggtaaattgagtcctcggttcattgggccttttgaggtgcttcacaggattagggatgtggcttatgagctggccttgccacctagcttgtcgagtgtgcatccagtattccatgtttctatgctccggaaggaaattggtgatctgtctcatatttttaatttcagcacggttcagttagacagcgatttgacttatgatgtggagctactggctattttggagcggcaggtccgaaagttgagatcaaaggatatagctttagtgaaagtgctgtggagagttcgacccgctgaggaggctacctgagagaccgagcgggatgcaaagaaaatacccacacctctttgaggcttcgggtatgtttcttgactcgttcgaggacgaacatttgtttaagagggggaggatgtaatgatctggccggtcatttcatgacttaccgctctatttccccatttttgcttctttatgtattgttcagatgtatttcatcacatcgcgttggttggtttggattagaaaaggttttgtagaggaatgagtcacttagtctcttttgagtaaccttaagttggaagagtcaaccggataatgacttatgggtagaaggtctcagatgtgaattctgatggtttggatagctttgttaggttatttgggacgtaggaagcatgatcagaacgtattttggaggtccgtgttagaattcggcttgaattggtaaaattggaattttggcttttccggttggtagtggaaatcttgacattagggtcggattggaatttcggaaattggagtaggtccgttgtgtcattagtgatgtttgtgcaaattttcaagtaattcggatgaggtttgataggtttttgtgtcgtttgcaaaattcagaagtttggaaatccttagacttgaatatgatggtgatttgatgttttgatgttgttttgagttttccgaaggttggaacaagtttgaataatgctatgggatgttttgacatgtttgtttgaggtctcgagggcctcgggtgagtttcgggtagttaacacatcaattattagcttttgaagttggtagatttctggtattttgttgtgaagaattccttcttcgcgtttgcgaagggataatgagagggtcagccgagttgttctttacgtttgcgatgtaggtccctcattcatgaaggtgtatgagtttaaggctaggcattcgcgaagggtgttccacgtgcgcgtatggtccagctgagtggtctttgcattttcaagtgggccctcgcgttcgcaaagaagggaatttggtctaaggcagcttttgatccgcgaacaagagggagctaccgcattcgcgaagaagaaaccacctcggcagaatgtttaagttcaacaacgatggttttggtccataatttcaaaattcattagagagctcgagagaagaagagtttggagggaattttcagaggattgattggggtaagtgttcttcgctcaaatttggttacatcccatgattatgtcttgattcttatcatttaatttgggaatttggggtgaatgttggggaaaatggaagagaatttggagagttggttttgggggtttagatggccatttgatgttggatttttgtgaatttaatatgggtagactcatgaacaagtgggttttccagttttgtgctttttatcggatttcgagacgtgggccgggtttgagaaaatttcggggttttgagttaatttgattatttttgcttgggctttgttcctttagcgtatattgatgataatatactgatttttgttagattcagagaatttggaggccgattcgagaggcaaaggcatctcggggaagagtttggaccggtttgaggtaagtaatgattgtaaatattgtcctgaggttatgaaaccccggatttaacattgtttcactactttgaggtgacgcacacgctggatgacgagcatggggcgtgcactattggggattgtgacttggtccatcatgtacgattattaagtcgcgtatttgattgaaaactatttgatactattgtgttttagaaagtattactatgttttagtttgaatgtcatatttgggcttcgtggcaaatgtttggacctttaggggctttttactactcttcctcactgttttgacttaatatttgtactcaatcatgttgtgttttacttattcaaataactcagttttgattcgataaatgatattttgagctgagcaccctatttttctgttagcctgagtggcttgagagatttttgacggagtgagtccaaggggtagtgttgtaaagataacatgggatcaggctgcacactgcaacatgttgtactgattatgatatatgagaggtgagagcctgatttattatgccactagattgcttgtgatagcgcttgggttgtaggagcctctccagaatctgacacccccagtgagcgtggatacccagtgtgagtgatgcgattttacccgaggggttgttgttgattcatgttgttgcccgaggggctgattacgagtgattgtgaggtatctcgaggggctggttctattgatattttgcatggggggcgatttatggtacatgtcttgcctgatgggctatttatgtttttaatatttttactcactgtttcatcacttgtttgaaactattgaaaggtgtttttaaaagaaaatgatttactgaaatagggtttgttttacgagataattaagttttgtactattttggaaatataatgtaattgatgtagtgctttgacatagaattatctattttcttactactcagattttatttacttttattacttactgagttggcgtactcacattactccctgcaccttgtgtgcagatacaagagttgcgggtcgcaatagtgagcattgatcgtccttccagtaggtctttgaagttggcaaggtagctgcttggcattcgagccctgcacttctccttcttaccttactcacactgttcctagtattttattttcagactatgatagttttccttgtacttagacagatcttgtagttgctcgtgacttgtgacaccctcgatgtcgggcttgtgtttcttccgtactggttattcagacttatattatgagattttgttaattaatggcttaaaatgacttttacggaataatggtatgatttgggatttgtgtcggctgatctagtttcacgataggcggcatcacgaccgggtcggttttagggtcgtgacaattgtattcatttgcaaaactcccatcttaggtctccaatatcattctttttgccctcttgcacttcccattactcacatttaactcaaaaatccttttcaaatgaagttccatctcccttaccttatacttaggattaacctgtagcttttccttaaagtaatgtgcaatggtattgaaatcaacagtactattatcatatgtagtgccacaattatgttctgactctaatgtctttacaataacccttgcattaccatctttgaatattaaacaaagaaagggacaacccacaatgcatctatacattaccctcattttgtcactcttcctcaattttaagacttttgtttacagtgaaaatggtaataataattaaatttgattatgggattctaaaaatatgtgatctatttttatgccagttgttaagcagttgataccatgcaaaagacttagaaatgagataagatcttgggagcaaggtgataaacaaactgaatgattaatagttggggccccgatcttgctgattgagggcctcggggttgagtctgaagctcggctaagagctattgggggtaatcgatgggcgattaacagttaagataaaatcaatgacggctctttatggccaatagtaagtaataagtgatgaacaataaataaaacacataaaaaatgtaagctataaatgaaataatgaactcaagagaatgtgttagagagcagagtgaatgttcttgtatatttagtattgagaaacagatatttacaaaatgataaggattccctttatatatgaggggtaatcgaaacatagtacaaatgcattaataacaaagatatggggttggtacaatcatttaatgccttgattcgcattttgggttagtccactaaacttgacctaccatatggacgtgccttgggaactccaccttgatccgtcgagatcggagattcacattgtctcggggccagtcattactcataacgtctcaaagttgaactgtctcaaaatcaaccatcgagaattctcggagtcaaacactagaggttttcgagatgtcgtgatgctcgtgaaatcgagctgtttatttctatcgtatacagatagtccctgcacttgctagaataaagtgataggaaatgattctgatcccctactctgtaagcatcatatccatgatgtcaacccatcagagtattaaatgccatactaaaaaagcagggcaagggtcgtcgtcaaacacgactattgagaaacccacaaaccgctattaattcattctttccgctgcccacatggctcctataaattcatcaatcgttcgataattcatactttcacaataccttcaaattttcaaggctaaatccatcccatttcacattcattactcatacgttctagatcttttgcctactttcgcagaaaacctttaccaccatcatggctagaacttcaaacacagttcctcggaaagacgaggatgccttttcatcctgaatatcaaaagtaaagcccaaggtgatacccaccgttaagcagtgcaactataccgggttcgacacaaagaaggatttttccatcgacaaatcttcatctacaccgggttgatgcaaacacgtgtcccgatacattatcgttgtgaccaatatagggaaagtgaagaaagattgccgatggagggaggcaatgtttgttgagatcaccactccaacgagagcataacggattacaaagctggtttcctttacgtatatacctacccgttcactttgggtccggtcgatttttcaaaaacttcttccccggagatagatccagttattcttgatttctgtgacaagtaccaagtgacgcttggtcaaatctatctatctttttggaggatagtatacatgctctgccaattctccaatgaggtcgagggtgcgaattttacccgcgaccatttgataagactgtacaaccctcgattttattgaggtttaattaagctgcactatcggtccaaaaagccatttttctagagcattgatgtaaacaaggattgagggtggatgagcaggttcgtccgagtgaggacctcagacatcatcctgtccgggaggatgccattcctagagaattggaatacacaatgtaagtattgttctttcgaacatgctttgtggtcttcttacctttctttcgataaatgatctctccttggtttttgcagctaccgcttggtatcctgaagcagttcaggatctgccaggatggattaagaatctagatacctcattcccatatatcgtgcggtcttggcccgacctggctaaaatagggtgggtggccaagaatcacggtaaagtccttctttccacccatatcttaattttatgtttctccctcataccctttatgctaataaacatcgaccattgtgtttgtgtatgcgttggcgatggtatgcagatgagactgcctcctgatggcgaggtagagacttcagagtccgttaagggctaaaagaggaagaataaggcaactgctgattctcctgaagcaaagaaacctaaatcatgtgggcctagatttgccaccaggacctcggcttcagcttctagagcaacgcctatcataggggatgaaaatgatgatgagggcgagtaccgtttagcataaagaatgagattgggtgctgaagtcccgcaggtgcccaaccggaggccactgaatcgggaacgtctaattcagatcggccccatgtgatggagacccttgaggagggtgtggatgtgatccctggtcccgtgatcgaatatggtgttgtgctcgttggggtgaccgttgatggttgtcccaaagggcttgggcctagaattttttgggagcaggagttgccccttggtaatatcgatgccctgggtggccttaatttgggccctcgggtctcgtcgaagaggttaagggacgctcaggacccgaatgccgccaacgctaggggtcctctcaagggggaagatgtactaggaaacttccttgatgatattgacgatgttcgcaaggacatcaatctcgatgctcccaatgacatcgaggcaacaaagaggttccaacggtagatcatagcttttcatgtatgcctttttagtctcaagaaattttccttgtatttctgactcttttgtttcgttgtagtctaagaaaatgtatgatcatgccctctctaggctacgagagtagatttcatgccgtgaaaaggagctcgagaagctcacctcgggactgcaggagtcggaggcctcctcttcccaaaaggagaaggaattaagtgagcttcgggcgactttcttgggagtgctccgagaaaaggctgatgttgctgagaaggtattttgttattcgtaaatccgttcatcattctcataattcaattttagtgacttagctttttctttgtagatcaggcaaaagaacgtggaggtcctcgagctgaagaggcaaaacgaggtagtgacctcggaattggcatagacccagggtcttctctgagattctcgaaaagatattgccgtgctatcagtcaccaagtctgaggccgaagaaaaagccgctacttatccgagggacgctgccactgtgaatcaaatagcccgagatataccggtgaaggccgagcaaaagctagttcggtctgtcgctcatgctagtgccaaggcgatgaggcaagctttagaggaagacaatgctaaaggtgctgatctctcagcttagatcgaggagtcttgagagtcggatgaaggattggcgctcctggttgctctggacgaaagtcccagagatgttcagagggcagtggcgatgaagagtatgcctgcaccatcgttacttctgttttttgtttttgtgtatgtattctcaaggaaacaagtcttgtaaagatgcccccttgtaaatatactttttggtaatacaagagaatttgtttttgtcaagtcttgcctttttaatattccaacgttcatgcggagttaacctttgaattttgatgttggctctttggagcccatacttggagtaatcaggggcctcgagatcaggtaccagcacaaaattaggtcgatatctcctttggggacgatgcttatgatagcaggaaccctcggggcccaaatacctcccaaacttcgcgtgacagcagtattcttgtgacctgatagtgggaccctgggggtggtcctgccagtacatttcctaaaaaaggtgacgcagtcatggccagaaataattggtcttctgggtaggaaagcagttgctgcatgctaccatatattcacttgcttctttctcaaatggcgattctgcgacaccgagcaattatttcttccatagaactttgttctttgtgctagttctcccgccgtttcaactcaaagccttcacacaaatcttcatcctcctcttcctatataccgtatccatggctactacattagaatctgcccatcagggaaaggggagttctgcccctgttccgtgtctggtcagtggtacaccgccagtactggtgagcgggcctcgaggtgctttgtcttgaggagagattttttgttgtaaagacctcccaatgttcaagggcatcgggagaattcatcgaggttcatcttttcaataagggaggaacacattgagatgattaggaaagactgcggatgggaggaatgagtagtactgcaggtaccttccctggaggagagcatcataacccatgtcaaggggtttttgagcgtgtatacatatcctttcacgtcgggtctccctgacagggttgtgcttgaattctgtaggagatataagattaacctggcgcgggctcacccatccctttggaagagagtgttgataatcaggtactttacgaataaggctgggctcaaattcaccctcaaccatctcgttaggttatatcgtccgctgcattaccggggcttgattactctgcaacatcgatccactcggtcctctatagtcaacaataaagaggacgaggactccataaaggcatctttctatttcattctttgtagcattacggacattgcattactgcattactggagagttttttccatttcctgagaaatggaatttcacacgtaagtggcatacctgtatttttatcgctttgtccattgtggaggcgggctccataaaggcatctttctatttcattctttgtagcaattccttggttgccgaacgaggtccctgctctggcgaaatggtcccccaagctggcttgttcgacctatgataagcgcaagtagtgagacttgtccaaggggatatgggaggcaaaccatcacggtaggtgtttagtagcttatttccttaggaacgtaatttctttttagcgtactaactctcccgccgcagatgttggaggttttcccgagatgaagccgtgcccccttgggggagagattgccgaccttggggtcgagggtcaataacaaaatagaaagaatccccgaggtgtgaggatgctcgcggcagggcgagtccttctttaaggaaaagaggtgagtcaaccgatcttccggcttcggaggcccctattttcgaaagaacatttcctgctctcgttgaaggtacttcgagggacaagggtcatgcggcaccttcctcttttcctaacgaagatacttcagggaacactaggccaacggacgttggctcgacctttggttaggctcagcagctaagctttatggtaagctttggtagccggtataggtttatcttggtttcgcgccctccctttcttattgaacgttcttttccatgcctttgacaagcttaagtctgagctacttcgccatgaggccaggctgagtttacctttgtgaccattattggaagggatataaaatacattagatcgttacttgaagtgtaattccgatgcaaccaagcttttagccattgaccattttacttgctttctagaatagtgtatatttccgcaattaaatcaatataaatccaaaaatatttctttaaaccgtttggctttgcaccataagcgataattctcctacattcctagtcgactacacattgtccctgtggattcgaccccatctcttagttgggtaaattatatttcgatcgatcatacctattgcttttgagtagtggatttggacgtacatcaattttggcgccgttgccggggacaatgttgcgtacattaggttgtttgagaagtaagcgaaagtgttttagtccaaacttgtgaatattgtgtatatttatttttcttgtttgcatagtgtttattttcgtatttttgaaaaatggcatcatttaataaaaattggtcggatggtagttgttcatactttgatgacccttgtcctttttgtggaggaccacattcgtggcaaaactgtttaaattctcccgggggtggattgtgcgcacaatctcaaacccatgagtggagtatttgtgataggtgtggttgtcaaaaatggtcatttgagttattgtgcatatttgtccttcccttccccaagcccccgctatgatgattctattgtgtttgatgaaaatgatagggctacagaaatggaagaagttgagcatggccgaaatggagaattcaagctcatgttggagtgcttacttgaagaaggaaacaaagaacaaagtgctttggaggagcttttgaaaaatagtctccaaaattctttagcacttgatcaaaatcaagaagagctctaaagtgcttaaaaagagaaaatgatgctcatgttgaagaacattcttgaaaataaggaagaaggtgagctaagatttgaagagtcaataatggaacatccgccaaccgaccccatgagtgttaatgatgccaagaaaaaaatagaattagagtcatccggtgtaaatgaaaaatcttttgaggttgactctaatccgggggaaaaagaggatgtcaagatagaaaaattacaaagtgaaggcttgaagttacattccaagcatttttcaacgttggaaatgtgtggtgacacggaagttgaaccacataaatcaatgaaggactgcgaggaggaaaacttcatgccatacattttacagtttgaagaaacaagaaagcaaaatgacattactcacatgcgagccaagaagtgcaaaatgaaaaatttaagcattggctcgatcatcaacttaccaccccccattgctcgtggtcacaagcttgattccaagctaggtgcccagttcatatcatcgaagtggcgagaaaagtggtaatgttgtttgcgtcatgccacgacgttaaatgcggtgcttggtgggaggcaacccatcgttttttaaagttttttagtcaattttgaaattttagtttttggaatatcttagaatattattttgtactaatctgccaagtttcagatcttttggagttgctttgagcaggtcgggatgacccggatggcaaaatccagtagctaccataaacctgccagtgcagcagaaaattgctctatgcgatcgcatagaagcaaggccgactcctctatgcgtttggaaaggttgaccagttaacccaatttttacactatgtgatcgcaacagtgctacgcgatcgcatagtgtcaggtaagttaaaaaaaattcaaaagacctccgaaacgtccaaaacccctccccctttctcaaaaatacagaattctcttcctcaagtgaaccaaataaattaaagggttaaaaaaattcttcaagtttcttgcataattttcatctccattctcaaggtatgtgatttcttcactctcttctcaaatatttcttcttcttcttggtgtaacttgtaaagtagaataacacccacttttaattggtcattagggtttaaattttaagtgttaagttgcaaattaatgcttaaaatgttgtttgtatgctggatgagtttggttgagagagtgagtgtaaagtatggaaaaatttgggttgaaatccgtgagaaattccttgaaaatgggcatagaaaactgatgaccctaaagtgtttgtgaaaatgcccaaatgagaataaaattctaggcagaacgaaaatacactatgcgatcgcaacagtgcaatgcgatagcatagtactgaaatactgaagtctgaaaatactctatgcgatcgaaacagtgcaatgcgattgcatagcactggaaagctgaatcctgaaaatgcactatgcgatcgcaacagtttaatgcgatcgcatagctttgaagcccagtagtcaaaaacagtgtgcttgcaaaaacgtttccaaacacattctgaattttttccttgacctaattccttcataataatgtgcattaagtacatgttcaagcatttaacaattggtctccatttgtaggtactttttacataaaatggcctggaaagattatgcaaatgtccaacaatatgcccttccaactccggaagatgaatattatgatgcagaaaaattcctgggagctgaatgtgaacgaaattatgacaaactcatgtcaaagagtattgtcaagtagcggggcatccgtttggaaaatgttgaggagaaaatgccggagttcttccagagattaaatgacaatggttggatatgctttgccctggaaccaatcaaggcgaactataccatagttcgcgaattttatgcgaatgcattgaagactgatttctgcggggaattgttcactgttgtcagaggcaagcgggtcaactttggccccgaggttattaatgcacattacaggctgcctaattctgatgatgaggtatacagagctataggaagagggagaggacctcaatggttggttgacaagctgcatggcggggtggtgccaacttgggtaagagcgcataaaggcgttgattctcatgagttcactggagaagccaagatttggctatcccttatctgtgccagaattgtgcctgctaggaatgagactgaggcgactctagagaaagcaatgatgattgctgcgattatggatggcctaccagcgaatgtaggccgacacattgtgggtgagattgaggaggcttgcaatagaagaacgagaagcctattctttccttcactgattactcagttgtgctatgatgcggaggtgccgacagactcgactgatgtggaaagagatcctaccacaacaatctttccattacttcgaagaaggccatctgggaagaagaagaagagaaggatcgatgtgcagtctccttcatttgggcaatttgatgagccgacagagggatccggtagtgaccccacagcttcagcagggtcctttgaccccatgggaccgctccattccggtcctcgcactatacgccatatttcccaccagatagtaggtgttgatgcgcatattcaacagcttgttgcaggtcttccctctagaccatctgattctacaccatctgagtcagccattccatctggtgagggttcttctactgggaaaggcaagaagaagcaaccgactttaagtgatgtggtgtgtgatcaaaaagcaataaagaacagactagaagaccttagccggaggcaaggaaaagttgaaaggcgacatacaaaattcaaggagcatgaaaagaagaaaagcaagttcctgtcgcggatgatgtcgaagataagctcactatgtggttcacaggattcttctgatgatgatgatggcgatgcactaaagtttcctaccacatccgactccgagtgatgcagtatccagggagcacttccaccattttattctaatatgtttagttgcattggggataatgcaatatcttttgttggggtggcttcttgtataactgttgttatggcagtttagtattgtagttgtttttgttttatttcgtaataaatttgtgtgatatctgacattaattatattagtaattatgcattaacttcttaattttatttattactagtatctgatataatcttttttaatatttagtgtgttttatattagtggaaatatccttagttttctttataccacggttcttttcccaaggatgccaattttcttctcttgaacctggaaatagtagataattttgattttttttaattttattttgttgttatgcactttttccgataatggatagctgtcttaagggaattagtcttgttgttagaattagattttgtaaaataaatgatttgagttgagttgggatttttggccattggctaagttgtggcttgcttggtaccaacatagttaaaccttcgcatatgaatttttggtggttgaaaaagaaaacaattgaagtaaaaatgtcatgaccttttagattcaatttttggctctttaattcactaaatagtttcctttatgctatataacatttttgagtcatttgtgttaattggaatgtggatttgtattccatttgagttttcatgttccatgtgcggtgatatgtatttgttagttcttttgtattatttgtgatctagaacttgcccggaatgtgctttgaggcgaaattatagactaacttggcttgaaaaatgatagaggccttccttggaccgctagtatgcctaaaaattcctacccttaaatattttccctagtcaaccaattttgagcctttaaccttattctttggcaaccatgttacatgctaaatcctttgttcttaaatgatatatattttagcaccctacttgtactttgaaagtgtttatgtaggctaaaagcctaagtttgggggtgaaagttgggaaagttgtgatatgaaaattatttgaaaatgtgaaaggtttataaataaaataaaaaaagtgtatatgtgtttataaaaaatgtgaataaaaggaagactagatgtggaataaaaagtgaagaaaatgtggaaaatatctttgaaggaagtggactttaattgtaaaatttgtagtgcttgggaaagttttgagtcactttaaccaaaattgtgccttaccttaaccaaatgcctaaaccacaaccctttaagtcctaattaattttgaaccatgttgtctacattagtggagaaatacatgatgggcaagcctatggtactacttgtatgcatttgaacatctttttgagagcgagttaattctttccatttgatatcccattttttatttaaattgagatttatgagtgtgggatcctctcttaaatgtaagggcacatgagaatttagttgtgaatttaatcccattcccaattgataagaatgaccaaagaaagttgattgtgatattgaggcaaaatttgaagctttagtgtcatgacttgattgctactttgatttgtattagtgtttgagcacttaaagtataatgaagtttatatgaagtgctcaataattcatatgctttggagtaattgttggtaccaatcaaagtcatgcttttgtgcttgtagtatacctattttgcttggatgatatggatacattgttgagttaaatacttgggaggagattttgtcacattcattgcttgtggacaagcaatagtttaagtttgggggtgtgataagtgggtaaaatacccacttatcttgtctttaaacctatacttttgatgtgtttaatgataaaagtcatgtgttttaatgtcgtttacttctattttacaggttgtatgtgatttagaagtaatggtgaagaaaccaagtgaaaacaagccaaaatggagcttaaatggacaaaatacagctgcccagatttatacactatgcgatcgcaataaatgctctgcgttcgcatagaaacagagaaaccaaagctatgcgaacgcaattatacagtgcgaacgtatataaggaaagaagtctggtcaacagttggtcaaatgctctatgcgaacgcatagaccactgtgcgatcgcatagtatacgggaactaactctatgcgatcgcactgcttctattgcgatcgcatagagttaattaggggcagtcctggaatttaacttatttttactctaaatcctttaatacccaaatcagttcattttgtacgggtcttttggcagtcttctgacatttttgtcttgagagcaaggttggaagctaggttttgcataaacacacttgggtcttgaagattgaagcttgtggttaagattttcttacctatttatgttgctttcttcatttccttgctttgtattgattatttaagtgtgtagtattgatttccaacacttaatgttgattatggaaatattcataattaatgtgtaaatttaataccttgttgtgcttatgtattaattgaagttcttgtattgttaacataggttttgcttgttgaatattgatttattcaactacatatttattattagttaattgaaaggaatttcaattaaccatgcctatttagtgtgtatctactcgagagagagtgcatatttaggtacttgttgaacaacatcactcccggagtatagacgagagtcataaccgagggtttagaggttggattagagatagcgatacctcgggtgcaatctaagtgaaccgttatgcgaatctagctagcgtagctcgagagagatttatgttaagtagagagttcacgattgataaaagcaactaagtttacctttgtgaccattattggaaaggatataaaatacattggatcgttactcgaagtgtcattccgatgcaaccaagcttgtagccattgaccattttacttgctttctaaaatagtttatatttctgcaattaaatcaatataaatccaaaaaaaattctttaaaccgtttggctttgcaccataagcgataattctcctacattcctagtcgcctacacattgtctatgtggattcgaccccgactctttgttgggtaaattatattgcgatcgactgtacctattgcttttgagtagtggatttggacgtacatcacggaccacggagaggtaaacgctggggcggcgatttttggcggcaacggaaatggaaatccgagaggtacactataaatatgagatttaggattttatttcatattttgacatagagagctcgaatctgggcaatttttgaaggattttaaagaaattcatcatggtaagtgattctaacacggatttggttaatatacgtgaatctatcattgttttcatcgttcaattagtattttgaaatgaaaatttggggaaaattgtagaaacttcatacaatgaatttttgagatctgaatgtcgatttggagtcggatttgagtgaaactagtatggttgaccttgtaattgaatgggctatcggattttgtgagttttattggatttcaagacgtgggcccatgggaaatttttgagttaaattttggatgttgttggaaaattagtcatttcgtacgcaattcactcctatacattgtattgaattattaaaatttatctgtggctagattcgaggcgtgaggaggccaattcgcgagataaggacatagcagaataaagaatttcacggttcgaggtaagtaacagttataaatttggtcctaagagtataaaaccccagacattgtgtcgtatgactattttggaggtgattcacatgataggtgacggacgtatgggcgtgcgccatagggatcttgacttggtccgtcccgtgagactgtggaatcaattggcctactggttaatacacgttccctctattttcatggaaattgactgtactttatgtagaaatagtgtttagaccttatgtgataattgttgagacctgagaggttgtttacgtgctaaattagctgttaaattgttgtttgtactcagtcataacttttcttgcatattatctgtcttttcctgtttatcattgatacatgatattacttatgtctgggttgttcctatgatttttgagagcccgagagactggagaaattgatgactgagtaaggccgaggtcttagttatgaggttattaacactatatcgcgtgagttgtctgtgcagcatgtgtttgtccgttcggatccagatattgatactataacacgtgagttgtccgtgcatcacgtgagttgtccgtacagatccagatattgatactatagaacgaagttgcccgtgcaacatgtgagtgtcgacgccccctttttcgaaaagcttacacggaggatagctccaaaatcaggtttacgacattatgggcaaaacaactcttattccggttaaggaatcgggttacagatttgaagagtcgccatctaatgattatagtgcattaggacacttgaaataaagaatacttttagatgaaaatcagagttcgggtaagggcttgagattatctcgaggggaaggtgttagctacccgccaagatccacaagtgtggttcccggccatgcaaattgtgacttttagaaagaagatgaagtaaacaagcaatgaggtgcacatatacaatattcaagcagttcaagagggttaaaaaggaaagaaggacataagtaaaaaaacatgattaatttgaaaagcgtttttaagagggaaaacatttgaacataaagcgtaaaagagagggatcctaggttgaagttcaatatggatcatttggtacaatacccggcaatcattctcactcaaatggtattagcgtaccgtcatcatctccatattctacccttcccgcccataaaggtcattaaaacgcgttggtatcgtttgcttagtgcatgctaatacccgtcccgacctattcagtcccgggacattaggacttctaatcctaaatgggaaaaggaagtagggtatatatatagagtgttcaaaggtaaaagactagagcgacattcaagaataaggagcaagtaaagggatgcatataaacaagtaaggctcaaataaaaccccatagcaaacaacaaatagcttagcatgacttcagttactaattagtctttaaaaaaggttaaaagagcaggcagatttcgttagaacacataagagttggatagaaaatctgcttcgagctcctcgggcccgtttcaagagttgatagaattttaaagattgttgattagtttcagacgatagtctgttgaaagaaagctggagttgcaaaaaaaaaaatttagaaaaaggcttactagttagccacactgtttgaataaaagatgcaggaaggaagacttttaagcgtcaaaaattttttgcatgcaagcgagtgaggccacatatttgacctctaaagaaaaagtgtttacagattcagagtggtaaaaaggggcgaatctgagcccgtttgaagtaagcaaatttaagacaaatcgaaactgaggcgtttgaagcttaggcgagtttgggacttataacacttatcagccactttgttactgcttttagacggcctactgtttttgcctagcgtttaatagttcatatagacatattttctaggtgagtttataaaaatgcaaacctataagcatggtctctacatgaagttgatgcaataacgaaaatacctatagacgtagtgtatacatgatattgatgcaagatctacgaacctagtaactatatgggacggctaaaataaagcatatgaacatgcattctatatgaagttgatgcaacggtgtaaatccctataggcatgatttctatatgagtgcaagaaagtagacccctcccatgtcccttttgctataaccccgaattcttttactacagattattacaaaactgggcagaaagggaaaaagttaaatacatcaacagctataacagacctgaggaagctagaagcagctttaatttccaacatgaacctttaaaccaagtccaagctcccaagatccgaggcctttctcatttttaaggatgttacaaagttccaaaggccctgataggggcccaggcattgcctacaccttaaaggaacagtgcaagtgtggaattaccagccctagggcatccaagtttagaggagactccaaggcccctaagcatggcgtaccaaaggggggtagaacttaaagaactaggagtaagtgtaaatgtgcagagtttagaggaaaaccaatacgaagggttgtcatacctcgccatggaggagactagcacacccctaaccctttgcatggtttaacaagcaagagcagacttgaacaaagtcagactagggcctgtgtggtgattagggcaccaacaggcctgtgtcaatgctcaacacatagtataggggggtcagggaaagggatcactttgagtgtaggttgagaataaccttagttttagactagaagtggtattgaagtaccagcctagtccaatacacaactcacatacaaacaggggtagggaagggggtatcacataagaaagcagacaacacaaggtaacattaaagattcagcggaagttgagcactgtagtaaataatacacaagccaaggaacaaggggaaagggatttacatgctggagcttaaagtgaaaaactgaaataaacagataaaggaacaagaggccagggaattaatactgaattaaaacataacaagcagggaaatggaaatgatttgaacataatggaacttaaagcaagcactgaaataaacaaatagaggagtaaaggggaaagggattaacattgaagttaatcataacaactaaaggaacatgagggaagggttaatcaaaattgaaaatatagcagtcagagaacaaggtgaatgtaaacaagtagtggagaattgataattgaaattggaacctaccagtgaaaacttgaagaaacaaagcagatagaaaccttttattagcttagacttcagttggccaattcttggcaaagagagagcaagtagcaagtagcaagaaagaacagagagatttagtgagaagagagctcgagagttgagttctgagttgtctcttgcgtgaaaggagggggtctatttatagttgaaagtaggcaagtaaataaggcaaacatcaattaaaatcatgcagcaaatcagaatcccttcagtaaaggggtcgattttgaataagagagggctgacaggtttatttaaggaaagggaataagtaacacatagtataatcaaggctaagtacatgaggactttaaaatcacacggttaagcaaaataaggaaagcatgagtcagtcaatctcctagcaaatcaaggattcacagattcttacttaacaacgaatatggtcaaaaacaagtctaagttcaaaaagaggagaatctcataaacaaatcaattcgcagaacttagggctactttgaaagcatggcatgactataaagagggacataaacttaaacatgcacgactaaaggaatcaaacagagtagcagagagtagtcataggttttgcacaacatagcaaaaaattagagagtttagagaatagaagtgtcgaaatcaacagacaatcaaacattgcatacgaatggcatgaaacccctagagttcagggcttcttttcacaggtcgagttttaaaaagtgagagcatagaagagtggtcaaagagtaacccagagaactcaaagaacacaaacatttgtgagaaatcaacaaaggaagagcagtaaagggttgtcctgcaaaccctagaaaatatagtgaggggaatacacagagaacacagatagtcacttagacatagaagaaatcacagtaaacaaatagcaatcaaagaaaacaaacataaaatttgcagaaaccctaggttttaaagaagacggacgattcttttgaaaactcgtaataaattaaagtcgggataagatatttgaaaaatcctttagaaacaacaaacaccacagaaataacgcacaaaaatttaagaaggaacctcgaatcgatttagggtttcataagaactcggagaaatggcgagaaagggcctgacggctcatcgaagcttgacaaaggcttcaaagcttccaaggcttgccggagaccaagcgttgcagccataaaagcttgagtcaccggacctctggtccctttacccacgaagaaaactccgattcctgaacccccggaccaggaacgatgagaggtgagtgagcatgagagttttcggccatgagacggccataaaaaccggtgaaaccaccatagaggtgattagggttagagaggatttcagagagggtaagagttcaaaggcggcggatgtaaacaaatgaaatagggttaaggtgtttggtatattattttggtaactaaagatttggaccgttgatctaaaagatcaacggtcgagatcagcttgggaaaaccgggcgggttaaaaatgatgggttagggtcgggtaattacaaggtatgggtattttaattgggctgagattaggggttgtaatgtggctataattgaaatggctgaggccacaatttaaatacctatttcccctcacaaaataattttaaaaaatagcaaataatttctaaaaaatgcaataaaattactgaagtactaaaataaatttagaaatttaataaaatactaagaacgaatttgtgaaatgaaatactatttaattgagaaaaagggctaaaattgcaattctatgcaattttgaatttaaaatacctaatgactttgtaaaaatcctgtaaaatcacataagttgtatttttatgtaaattggaaaataaaacaatacctttatgaaaatagcaaagttttaatatcaaatgttgatttttatagggtaaaataggttgtaaattaaccttaaaagcttaaaaaatatagaaaaaataccacactctttgtggatgcttgtatatgcattcacaagctatttaaaaaatattttggataaaagtatatgagggaaaaattgggtatcaacagttgcccctttttacccgaggaggatgaaagagttgttgggtaaagataagatggccaattttgaccgggagtgaagattatataagaatttcgaccgtgctctggtttctgagcttcccagatatccctggttttacaggaatcaggccgtatgtagttcgggagtcgtcggtggaatgtgccgatgacaaattggaaagcggacgtaacggggtttgatgttttggcgggggttcggagatcggatgagctgcggagaaccggggtggtatcgctcctgccaaaacggtcgtgccagccggcgtacctgcgaatagaagatgtgcgtgtgtattgcataatttcaacgtgatgcaaattcccattggaccatgaatgctgtcttcggacgatcaggatggcgtcctcagactatgacgtccgggctatgaagagcaggaatgtaaagattcgcaggccatgaaatgatgttctcgggctacgaaggtggtgcctccgtactatgacgcctttgaataagttggcgatatttcagcccatgaagagatggcgatatttcagccgaatgaatgcagagagtggcgatctttcagccgagcaggaatattaaatgcaaagtggtgatatttcagccgaaaggaaacaggatggcgatatttcagccaaatgcgagagataaaagaggcagagcttagcctcgaaaggcagagaatagccttatgcaatgcaagagatgtagacagagcttagtctcgaaaggccgcggatagccttatgcaggatggaggcagagcttagcctcggaaggtagagaatagccttatgcaatgcagaaaataaaggaggtagagcttaacctcgaaaggccgcgtatagccttatacaagaatggaggcggagcttagcctcggaaggcagagaatagccttatgcgatgcagaaaataaaggaggtagagcttaacctcgaaaggccgcgtatagccttatgcaagaatggagacagagcttagtctcggaaggccgcgtatagccttatgcaggatggaggcagtgcttagcctcggaaggcagagaatagccttatgcaatgcaaaaaataaaggaggtagagctaacctcggaaggtcgtgtatagccttatgcaagaatggagacagagcttagtctcggaaggccgcgaatagccttatgcaggatggaggcagagcttagcctcggaaggcatagaatagccttatgcaatgcaaaaaataaaggatagtggtgattttcttagctggtagatgatcgtgacatcttgaccgctggggaaatggtgagtatagatagtaaccctttgcgcagtgagtacattgctttgagagtctgttttcgggaaatgattgtgtcgttcggccagtgcctcaggtacctgcatccaaagaaaaatcgtgagttctgcaaaggggaggttagttcgtatccctcggctcgcggcgccttgtaccatttgggggtagcgttgctgaacgacattgatccagataattttatgaaaatttaatagatttaaggtaagtgtgacgcaaatgtatatatataagtagggaaaatatttttgttctatgatgaaccgaccaacggcaacgtggtccgagtcacggcaaccttgctggtaccggaattttgagggtcctcctcaaaattctgccccagtttactgggctggcgatgttgacggcgacactgtatgactgaaagctgaccggcctcggaattttgagggtcctcctcaaaattctgcattttgagggtcctcctcaaaattctgccccagtttactgggttgatgctgatgcggcgatctaaaagactaacttcggaattttgagggtccccctcaaaattctgccccagttccaaatgcaggggaagatggaattttattagagatttgaccgaacccatagggctgcctacgtatcccctcttaaacgggaatcaggtcaggcgtagttcaaattatatcacaaggacacataatgattaaatgtagtatctctttactgcatccgagttgattggttttggtcaaacttctccgtccatttctgcaagaataagggcttctccggttagaacccggtgaaccatgtatgggccttgccgattgggagagaatttccctttggcttcatcttgatgtgggaatatcttctttaacaccagctgtcctggtgtgaactttcttggttggactctcttgttgaaggctctggtcattctgttctgatacaactgaccgtgacatgctgcgttcatcctcttcccgtctataagggctagctgctcgtagcgaactttgacccattctgcgtcatccagctatgcttcctgtatgatccttaatgatggaatttctacctcagcggggatgaccgcctccgtactgtagaccaacatgtagggggtggccccggtcgatgtgcgaaccgtagtacggtaacccaacagagcgaaagacagtttttcataccactgcttgtgcctttcaatcattttcctcagtatcttcttgatattcttattggctgcttccacagcgccattcatctgtggcctataagctgtagaattcctgtgcctaatcttgaaagtttcgcacattgttctcatcaagtcgctgttgagattggaaccattgtcggtgatgattgattccggatttccgaaccgacagacaatacggtcgcggacaaagtctgccacgactttcttggtcactgccttgtgtgatgctacttccacccatttagtgaagtaatcaattgctaccaagatgaacatgtgtccatttgatgcggcaggctcgattagtccgataacatccattccccaggcggcgaatggccatggtgagctcgttgcagtaagctcgtttggaggcacctttatcatgtctgcatgtatctgacatcggtagcattttcggacatattggatgcagtccgtctccatagtcatcaaaaaataacctgctcgaagtatcttctttgccaaaacaaaaccattcatatgcggtccgcaagttcctgaatgcacttctcctaataacttggttgcttctgttgcatcgacacacctcaatagtcccaaatcgggagtcctcctatacaggattcctccgctgcgaaagaagttattggacagtctccgcagcgtgcgcttctgggtagcactagcaagttcgggatactctccagttgttagatattctttgatgtcatggaaccatggttttccatcggcttcttcctcgacatgagcacagtaagctggttgattgtgaatcaggacacggatggggtcgatgaaatttgtatctggatgctggatcatggatgatatggtagctagtgcatccgcaaattcattctgtattctcggaacatgttggaattctgcctttctgaatctcttcttcaactcctggatatgatgcaaatatgggagtattttggaattcttggtagcccattcttcgcggacctggcgtatgagtagatctgaatctccgatgatcaataactcctgaacgtccatgtcaatggccaatttgagccccaagatacaggcttcatattcggccatgttgttggtgcacgggaacctgagtttggcggttaccgggtagtgctgacctgtttctgataccaaaacctctcatataccaactcccttgaaattcacggctccgtcgaaaaacatcctccaaccatcgtaggattctgcaatgtcctctcctacgaaattcacctcttcatcgggaaagtacgttttcaggggttcgtactctccccctacgggattttcggcaagatgatctcccaaagcttgtcctttaactgccttctgagtaacataaacaatgtcgaattcgcttaacaggatttgccacttggcgagcttgccagtgggcatgggcttctgaaaaatatactttaatggatccatccttgatataagataagtagtgtaggcgcagaaataatgcctcaatttctgggctacccaattcaaagcacaacaggtgcgttccaacaaggaataccgagcctcatacggggtaaacttcttgctgagataacagatagcttgttcttttcttcccgtttcatcgtgttgtccaaaaacacaaccaaatgctccatccaggactgcgagataaagcaataaaggccatccgggttcaggcgggaccaggactggaggcgtagacaagtattcctagattctgtcaaaagccttttgacattcatcggtccacttagtggcggcgtccttcttcagcatcttgaagatgggttcacaaatgacggtagactgagctatgaactgactgatgtaatttaatcttctcagaaaactcatcacatctttcttgtttttcggaggcggcagctcttgaatagatttgactttttatgggtccagctctattcctcggtgactaacaataaaacccaacaactttccagcaggaccccgaatgcacacttggcgggattcagtttcaaattatacctccttagtctgttaaagagtttccggagatcctccatgtgatctgcaacttttctggacttgatgataacgtcatccacatatacctcgatctctttatgtatcatgtcatgaaaaatggtagtcatggccctcatgtaagtagctccggcgttcttcaacccgaacggcatcattctgtagcaatacattccccatggcatgatgaacgccgttttctctgcatcttcctcatccatccatatttggtgatatctagcaaagcaatcgacaaatgactgcaactcgtgtttggcgcagttgtcgatcaaaatgtgtatgtctggcaaggggaagtcttctttgggactggcccggttgagatcccggtagtcgacacagactctgaccttcccgtctttctttggcactggcacaatattggctaaccaagtcggatactcaaccatctgaagaactctggctttgacctgtttggtgacctcttctttgattttcaaactcatgtctggcttgaactttctgagcttctgttttaccggcggacaggctggatcggttggcaacttgtgggcgacgatagacgtactgagaccagtcatatcgtcgtaagaccatgcgaagatatcctcatattccttcaagaactctgtgtattctttcttttctgccggtgataagtgcacactgatgcgtgtttctttgacattatccgcatctcccaaattgacggcctcagtttcatctaagttggacttaggcttgttctcaaaattctcaacctcttggacaacctcttctggtatctcatcttcttctgaatctatatccgtttgttgcatagtctcgttgcaagttacagtcgtcggttcatcatcaagatatgtaatagtaatgctgtgtaaataaagtaaatagcaaaaaaagtaataagcggcaagatatttaataaaccgagaaagtacttttgattgaaattcataaatgtttaaacatcggagctctttttggaaagtaaagacattgcggaaattaaagaaagtgattaaaacaaaatgcatggtattcgttcagccttgctaccccgaagatctacgggcgacagtggtcctgattgaccagttggtgaggcgctccccttggttcacttccagaatggaagggccttcctccccttcatcctcaaaaatcacacaacaatccatgtcctcctccagaaacagattcttcatagccgcgagagcctcgtcttcttctgaaccatagagagtgtcggcgggctgaaatgtctgctccagctgaggtaaggggtactccaatggataataggggtcgcgccatggtggcgaccagtctttgaattcttcccaaacgtattcataacccaagccgaacgtagtaccatgtttcttcaaccggataggtttagtgatgccttgaagattcttaccgagccctttacctggctcataccggctccagttcaaaatgctttcaattttgttgctccaccatttgtctttgtccaccgcatttactcgttcaatgtgatgatatgtttctctacctatccttcttcttcctctgatcattgggacggtttggcgactgtatataggatggctaccgtcgccgtggatgatcacttcctgatgattccattcgaacttcacggcctgatgcaaagtcgatgccacggctctagcagcgtggatccagggtcgtcctagcaacaagttgtaggacgctgggacgtcaatgacttggaaatcaacatcgaaccaagtaggccccatttgtaagcataaactgatttcttcgagggtagatctctgagacccattaaaagctttgacactgatcgctccgtcctttatctcgtgcaaacctttgcctagtgttctgagggtgaccaacggacaaatattgaggctagagcctcaatcgaccaagatctgggtgatgaagtgatcctcgcattgcacggtgatgtgtagtgccttgttatggcccaacccttctggtggcagctcgtcctcgtggaaagtgattttgtggctttccagcacttgtcccaccatgttcgccatttctcctcctgttatgttacttgggatgtatgcttcacttaatatcttcatcagggcgttcttgtgtgcctcggaactttgtagcaatgctaagatagatatatgtgctggagtcttgttcaactgttcagcgaccgagtattcctttgcctgtattttcctccaaagatcatctggcctagtctcaatagtacgaccagaggcctgctttctggactcggctaggtgctctggtgttaaaccctgcctgttctagtcataccctgtgccgtagttgcctcacccgtgcgtgctttccctttccttctggatttagctgtgtaatcccaaggtatggcattggtttgaaaatggcttatgtctgtcatggtgactggaatgggcacccttcgtggcaatatagtaactttgactggtgcgggtgctttcggagttccgaactccactttaatggttttctgtacctccgcagggggcgcttcaaattcgaacgggactggtatgtttaccacgtcgccctcagatggctgtatctgcacaataatgggattgagggtgactgccagctccctaggtttgtctccttcagctatcaaaccgattgacccattggggtcccaatcatcctctatctcgatcatatggatgctgctacctttgtgatctggcagggggttgtttcgaacattaggtgcaggctccttggctacaatgaccttactatcaatcaaggtctgaatcttgtctttcagggaacgacactcctcaatagtatgccctttcatccccgaatggtatgcgcagcttttgtttggattgatccactgggaagggttttctggagtgacggctgggatgggcgtgacgtaaccggcggttttgagcttttcatatagctggtcgatgggttctgcaatggcggtatattgtctaggcggtttgccgtcgaagttgggtcttggtcgtggaaaattttgtcgagtaggtggtgatgggtaatgcaaaggttgagagtggtatgcttggtaaactggtgctggtgaggagggctgataagtgggcggcggaggtgattggtaggtaggtggtggattttggtatgtgggtgatggtacttggtagctcggagggatttggtatgtgactggggttggagggtaggtttggtattttaggggagattggttgcgctgcgcacccattgcagagtttacctctttcttcttggatgtaccaccggactgcaggactttgctagtagactgcagtgcctcaaggttagtgaccataccatttttgattccttcctcaatcctctcccctaacttgatgatatccgagaacttctgcccttctatcaacatcaatctttaatggtattgtgggtcctgagcacggacgaagaatctgttcatctgctcctcttctaaagctggccgaaccttggcagcttccgacctccaacgagttgcatactcgcgaaaggtttcagtgggctttttcttcagattctgaatataaaacacatcgggcgcattctccatgttaaacctgaaacgatccataaaattcgaggccatgtcgacccagtttgtccattttctcgcgtcctggctgaggtaccaagacatggcatctcccttcagactcctcatgaataatttcatacgaatcttctcatccttcccgactccgaccagcttgtcgcagtacatcctaaggtgaaccctgggatcgccggtaccatcaaacatctcgaacttgggaggtttgtacccctccgggagttcgacatcaggctggacacagaggtcctcatatttcaatcccttcatacctttggttctttcataaccccgcatatggctggtcaactctttgagttctgcagccatgctcttaatgagcgagtctttggctcttgcttctatcatgtctgaaataggctgagcatagtgaggcaccgtatctacgaagataggggaccctgattgctgggaacatcctgtggctcggggttgagcagtggaacattgttgcgattatgagcatgattaggctgtgggccttttggtggaggaacagggacctgatcattaacatctgcagtagtgagggtaatcgacaagtttgccaaatttctgacttgatccaactcttcccggaatttcaatagagtctgctccaggtgagcagcaatttcctgggtgattggagtaccctgagaagttccttcgctttccttgttgtccgccatttttcctttgcttctgtttctaggaggacttggaagagggggaggaggaccctttgatcttgttgaataagctgatggtgccagaatgcacgaactaacccttggggaggggaataatcaaaaagaaaaacaaaaggtaagaagttagtgcgggttctgaataaagaaacattgtagtatttaaacacgtagttgcgagaaagaaatcgtttcctattttgggtgcctcgttatgcccgaggtaggcctagtgacaaatagaatttggagaacttataataccaaatgcctcatttcattgataaaaatggaatgagtcgaaaacagaccgaaataaagagattgtcactaatggccattggccttattacattttacgaaagcggtaaaaatcctaactacttggtcccagaaggaccttccccagatttggtgtctttccttccttcgtgcagcttcatcagctcccgcaatcctagaagtagataagctcgggccagataccctccttcattaccctcttcctcttggaagtcgttgatcctctttaggaacttaccctctaactcgaccaaaccatgctccaagtctccaagacgctcgtttgcgtggacagccatacctttccactcgttaatcagcttgtcttgagcttcctgtattttcctgtgctcgttatcactttcccgcatccgtttgcgtagttgattgtacctgacctttgctgtagttttctcatcaatgagccggtgaccgtggacaaaaccctgctttcccaaaccgatgtgatcgttctctaaccattctggatatagcggagtgtacccgacttgatacctgtcaggctccatagattctttatccaaaacgagcttggaatgccacatgtgctgagcttaacacctgtacggactatcgtcgttctggaagtctgcccgataatgacccatcttctctacccttggtatgatttgctttctccatgcctgcctcatggctcggagagggacataagggtaagttcctctcagacctatgagcacgaggaaaggagcgtccttagaccgaacaatgaaatctcccgtaggcaaccactcatacatctaatgtacctgttcttccttcagattttctaatagttgtacccacccgctggcgtcttcaggatgtgcgaacatgtctggcatgaagtgcattcatttcggatggtggaacgcgatatggttgtcccaatctcggcgtatgatttcttgcttatagtttcctttttggaggtgctcaaggaggcaaagctgtagtagcagattgcaaccctcaaaatgcggcatccctcgctgacactgtccctaggcccggtatagttctgcgaggatcataggtgctatgctgaatgtctgtttgtcaataccttccattaccgctttggttaccatggctagtctaggatggatcctatccttcttcattgggaatattattatgcccaggaagtagagcatgaatacaaaagcccttctgtgtatgtgccctagggaggtgatggtgaactcgtccatatggttgtggtaagacttgctgtgtctgaaccgctcgtacatgaagtcgaaggatatgtaagagtccttcagactagtcagactggaatttttcttaagtcccatcattttcaggaatcccctatctttgcgattttccggcatgagtaaacccggactgtcccaaggaatcccggccaaacccccaatttcttccagtaatgggagtcatctcaatgtccccgaaacaaaaaacggacctttcactatcccaaaataaagtagcagcctctacgatcttattgtctggcctaacctccaggagtgagggaagattgcccagatgtttgcgaaccataacccgatcactaccatggagatcataccaccaacttagtaacctgggatggatgtttgacaccatatcgaatctggggacctcgtgcctcatttctgcaaaaaagatggttaggccctaaccccaccagactcgactatttaaatcaacaattagcaacaggcatttagttctccaaattgatgcacgtaacgtgagggcgtccgtttgggtttcaagaaaacccggtggacgtttggttaaggctatcttaatgagtcattacgcggacggcatgactgactcggctaagtttgactaaatgatgcatgaacagtttaacagagtaaggtttctacttttgaattgctagacaaggtacccttgagcggacaactcaagagggaaaggcgcggaaccgtcgactacaccgttgatcgactggttttaccgcaagtatgcctttgccaaatttagggagtgataatatcagaagagcgcaaccactcattataagcgttgctataggattttgttagcacgagtggaatatgatgttgaaagatgcagttacaagtaaatacatgtattttcacgttcatacaataatgattacaataaaaaatgtggtatttaaagacataattgaagaaatgaaaaggcagtaaagcagttaaggaaaagaaaagacaatgaagaaataagtcagtaagtggaggaaatgattaaagcaataaataaatgcaataaaggagagcagtaaagtcacaaatgcttgtaatggtaaaagccttaaaagaaatccccagcagagtcgccatgctgtcgacgccccttttttcgaaaagcttacacggaggatagctccaaaatcgggtttacgacattatgggcaaaacaactcttattccggttaacgaatcaggttacggatttgaagagtcgccacctaatgattatagtgcattaggacacttaaaataaagaatacttttagatgaaaaccagagttcgggtaagggcttgagattatctcgaggggaaggtgttaggcaccccccaagatccacaagtgtggttcccggccatgcaaattgtgacttttagaaagaagatgaagtaaacaagcaatgaggtgcacatatacaatattcaagcagttcaagaggtttaaaaaggaaagaaggacataagtaaaaaaacatgattaatttgaaaagcgtttttaagagggaaaacatttgaacataaagcgtaaaagagagggatcctaggttgatgttcaatatggatcacttggtacaatacccggcaatcattctcactcaaatggtattagcgtaccgtcatcatctccatattctacccttcccgcccataaaggtcattaaaacgcgttgatattgtttgcttagtgcatgctaatacccgtcccgacctatttagtcccggggcattaggacttctaatcctaaaggggaagaggaagtagggtatatatatggagtgttcaaaggtaaaagactagagcgacattcaagaacaagtagcaagtaaagggatgcatataaacaagtaaggctcaaataaaaccccataccaaacaacaaatagcttagcatgacttcagttactaattagtctttaaaagaggttaaaagagcgggcagatttcgttagaacacataagagttggatagaaaatctgcttcgagctcctcgggtccatttcaagagttgacagaattttaaagatcgttgattagtttcagacgatagtctgttgaaagaaagctggagttgcaaaaaaaaagttttagaaaaaggcttactagttagccacactgtttgaataaaagatgcaggaaggaagacttttaagcatcaaaaattttgtgcatgcaagcgagtgaggccacatatttgacctctaaagaaaaagtgtttacagattcagagtggtaaaaaggggcgaatccgagcccgtttgaagtaagcgaatttaagacaaatcgaaactgaggcgtttgaagcttaggcgagtttgggacttataacacttatcagccactttgttactgcttttagatggcctactgtttttgcctagagtttaatagttcctatagacatattttctaggtgagtttataggaaaatatggatcacttggtacaatacccggcaatcattctcactcaaatggtattagcgtaccgtcatcatctccatattctacccttcccgcccataaaggtcattaaaacgcgttggtattgtttgcttagtgcatgctaatacccgtcccgacctatttagtcccggggcattaggacttctaatcctaaaggggaagaggaagtagggtatatatatggagtgttcaaaggtaaaagactagagcgacattcaagaacaagtagcaagtaaagggatgcatataaacaagtaaggctcaaataaaaccccataccaaacaacaaatagcttagcatgacttcagttactaattagtctttaaaagaggttaaaagagcgggcagatttcgttagaacacataagagttggatagaaaatctgcttcgagctcctcgggcccatttcaagagttgacagaattttaaagatcgttgattagtttcagacgatagtctgttgaaagaaagctggagttgcaaaaaaaaagttttagaaaaaggcttactagttagccacactgtttgaataaaagatgcaggaaggaagacttttaagcatcaaaaattttgtgcatgcaagcgagtgagggcacatatttgacctctaaagaaaaagtgtttacagattcagagtggtaaaaaggggcgaatccgagcccgtttgaagtaagcgaatttaagacaaatcgaaactgaggcgtttgaagcttaggcgagtttgggacttataacacttatcagccactttgttactgcttttagacggcctactgtttttgcctagcgtttaatagttcctatagacatattttctaggtgagtttataaaaatgcaaacctataagtatggtctctacatgaagttgatgcaataacgaaaatacctataaacgtagtgtatacatgatattgatgcaagatctacgaacctagtaactatatgggacggctgaaataaagcatatgaacatgcattctatatgaagttgatgcaacggtgtaaatccctataagcatgatttctatatgagtgcaagaaagtagacccctcccatgtcccttttactataaccccgaattcgtttactacagattattacaaaactgggcagaaagggaaaaggacattaaaagaattaaaaagttaaatacatcaacagctataacagacctccaacatgagcctttaaaccaagtccaagctcccaagatccgaggcctttctcatttttaaggatgttacaaagttcgaaaggccctgataggggcccaggcattgcctacaccttaaaggaacagtgcaagtgtggaattaccagccctagggcatccaagttcagaggagactccaaggtccctaagcatggcgtgccaaaggggggtagaacttaaacaactaggagtaagtgtaaatgtgcagagtttagaggaaaaccaatgcgaagggtggtcatacctagctatggaggagactagcacacccctaaccctttgcatggtttaacaagcaagagcagacttgaacaaagtcagactagggcctgtgtggtgattagggcaccaacaggcctgtgtcaatgctcaacacatagtataggggggttagggaatgggatcactttgagtgtagttttagaataaccttagttttaaactagaagtggtattgaagtaccagcctagtccaaaacacaactcacatacaaacaggggtagggagagttttagtgagaagagagctcgagagttgagttctgagttgtctcttgtgtgaaaggagggggtctatttatagttgaaagtaggcaagtaaataaggcaaacatcaattaaaatcatgcagcaaatcagaatcccttcagtaaaggggtcgattttgaataagagagggctgacaggtttatttaaggaaagggaataagtaacacatagtataatcaaggctaagtacatgaggactttaaaatcacacggttaagcaaaataaggaaagcatgagtcagtcaatctcctagcaaatcaaggattcacagattcttacttaacaacaaatatggtcaaaaacaattctaagttaaaaaagaggagaatctcataaataaatcaattcgcagaacttagggctactttgaaagcatggcatgactataaagagggacataaacttaagcatgcacgactaaaggaatcaaacagagtagcagagagtagtcataggttttgcacaacatggcaataaatcagagagtttagagaatagaagtgtcgaaatcaacatacaatcaaacattgcatacgaatggcgtgaaacccctagagttcagggcttcttttcacaggtcgagttttaaaaagtgagagcatagaagagtggtcaaagagtaacccagagaactcaaagaacacaaacatttgtgagaaatcaacaaaggaagagcagtaaagggttgtcctgcaaaccctagaaaatatagtgaggggaatacacagagaacacagatagtcacttagacatagaagaaatcacagtaaacaaatagcaatcaaagaaaacaaacataaaatttgcagaaaccctaggttttaaagaagacggacgattcttttgaaaactcgtaataaattaaagtcgggataagatatttgaaaaatcctttagaaacaacaaacaccacagaaataacgcacaaaaatttaagaaggaacctcgaatcgatttagggtttcataagaactcggagaaatggcgagaaagggcctgacggctcatcgaagcttgacaaaggcttcaaagcttccaaggcttgccggagaccaagcgttgcagccataaaagcttgagtcaccggacctctggtccctttacccacgaaaaaaactccgattcctgaacccccggaccaggaacgatgagaggtgagtgagcatgagagtttccggccatgagacggccataaaaagcggtgaaaccaccatagaggcgattagggttagagaggattttagagagggtaagagttcaaaggcggcggatgtaaacaaatgaaatagggttaaggtgtttggtatattattttggtaactaaagaattggaccgttgatctaaaggatcaaagatcgagatcagctgggggaaaccgggcgggttaaaaatgatgggttagggtcgggtaattacaaggtatgggtattttaattgggctgagattaggggttgtaatgtggctataattgaaatggctgaggccacaatttaaatacctatttcccctcacaaaataattttaaaaaataccaaataatttctaaaaaatgcaataaaactactgaagcactaaaataagtttaggaatttaataaaatactaagaacgaatttttgaaatgaaatcctatttaattgagaaaaaagggctaaaattgcaattctatgcaattttaaatttaaaatacctaatgactttgtaaaaatcctgtaaaatcacataagttgtatttttatgtaaattggaaaataaaaaaatacctttatgaaaatagcaaaggtttgataccaaatgttgatttttatagggtaaaataggttgtaaattaactttaaaagcttaaaaaatatagaaaaaataccacactctttgtggatgcttgtatatgcattcacaagctatttaaaaaatattttggataaaagtatatgagaaaaaaattgggtatcaacagtgagttgtccgtgcagatccagatattatattatagcatgtgacttgtccgtgcagtttatagctcttgggatgaaggatcccctcagtagtctacacaccccagtgagcgtaggtacctattgagtatgattattgagggctgagaattgagtgactgacgtgttgagatgaggtgagtgactgttgcctttgagaggtcgtatttgctttcagttaattgttgcacctagttgctatctatccctgttgtacaaatttctggaagatttgatacctagtttatgtgagaacgcactgatgtgacttaaattgttaaattgaaagcatgactattcttatttgaaagttattgagataactctaattgtataactcgtcactacttctcaattccttatttatttcagttacttactgagctgaaagtactcacgttacttccttcacctcgtgtacaaatcaaaacacttctagtcacggcggttgttgattgaggagtcagacccaggagactatcgaggtagctgtgataactctgcattgtacatgttttacaccccttcttacctgagctttgtgcataaattgctttgaattagtcccgaattgcttacaagttgcgcttgattgcaggtttgagtgacaagatgataaaaaacacaaaatcggctcaaaaaggagtgaaatctgccaaatgtcaatagatgacataaagtggggaaataagtgacctacgcggactgcactgttctggtgtgcggccgcgtagaaaggttcaaaggatgagcattcaccaaggccacctgcgcggaccgcactgctttgacatgcggtcgcgtaggaaaagttcagagacatggaatttttgaggaaaaccaacgcggaccgcaacaatttctacgtggtccgcactgatagattttcagaggctcagagattcaaggcacaaggcccacgcggccgcacaccaaagcaatacggtccgcgtgggtacaagttcagagaaccagcaagttggcaggtccttctatgcggccgcgcaccatttccacacggtccgcacgattcagcctacgcgaccgcgtggcatttccaaacggtccgcatccctttatccaaaggcgactgaagtgaagacaaattgccctacgcggccgcatgcaacttctgtgcggaccgcgccagaccctcaggggtatttttgtccggtgtttcctatgtagtataaatagaacactttactttttaggttaagttttgtcagctgtgtagcagctgagtacgagatagtttatattagcctactttaggcaattttcttttgtaattaatgtggattcaagtagattaagctagtagttaatgataatgttgatatcttctagtatttctgctttttctacttcttccatgtctagctaaacccattagctagggttgtgactcaacccttgtgtgggtaattaatgggtgtttttgcttaatacttggatgttatcgggtgtttggtatttgggttgtttgtatgttttcacttagatttggtggttgcaaacactaagtcaagcttagtgggtcttgagtcttcttgagaaagagagtctatgacctcgcaatcaacccaacaaggatttgggatagacccatgagaatggtagtcccaagtaacgggttaaatattgagagagtaattaccccacttgaaccttgtgttgcttgggcaagttagcctacccaattggtatcgagggagtcaattgggaaaaatcgttctctctaccgaggagtgtgagagtgctaaaagtgaaacggttatccatagtccccataattagcatccttgtgttagaattttatacccgttaattagacacctaggtgagtgtcacgaccctagtgtctttttcttattgcttacatctggtatcaacatcttagcataattttagttcataatagtagttgataattttagttgttaacaatagaaaaacccaaaaatgatagaagaccaattagaagctagaaggcatttctaagccatacaaatacgcaactctaacttaaagctctctgtggaattatcgaccccgatataactattaggttattagtattcgcgcccactctttcttaggattgagttcgacacgatcactttttggcgccgttaccggggagctttaggtgtttgactatttgtttgctagagttgtgttcttgcttctctttccttctttttacttattttgtttgttaatttcactcgggtaccaatggctttaaacggagttgatgctcttggtaatgtggtggtggaagaggtggaagatgtagagcaagaagaggttttgccccaaccacaaaggcggggtagaaatgcaaatgctccggtgaatgctaatgaaaacaacataccagaccctcctccaccaccaccaccaagagtcgcaccaaggattctacccaaccaaggttatgctattgcaatagttcctccccgaatccgggtggggaacttccaaatcaccaacgtcatgctcaccctcctggaacaacgagggtatttcgtaggcgcttcggaccaaaatgcatacaagcatctaaaagggtttgtggatacttgttgggggagtaagcagaccaatgtctctgaagatgcactacggctaaggcttttccctttttcacttcgggggaaggcattagattggttggagaggttgccaaatcattccatcactacttgggaggaattggagaataaattcattgccaaattcttctcgccaagtcacatggcggctcttagagatgagatcctagctttcaagcaagagccgacggagcctttacatgagatatgggagaggtttcggacgatggttaaagagtgccccaacaatgatattaatgatgtcatgtttcaacaaacattctatcgggtataaatacgacaaaccagtgcattgtcaaccagttggccggtggtaactttatgaagcttccatacgatgaagcttgtgatctgttcgatgaaatggccgatacttcgtcggcatggcaaagccgggctaatgttcctcagggtgatcccaatgttattcatttgcacaaggagctacatgatcatggacaagccatagccgaactcacaaccacaatgaatcagtcggccaaggcacagcttcaacaagttcaaaatccgcatcaagtaaataccatggaaggggtgaatttgatgaaaagaagacaaagaggacaacaacaacccccagaaaattataactttgacgataggaatggtggttattcgaatgatggttatgaggaccaaagtgaggaggtacaatatgtgaataacttccaaggaaatagaggaaaccaagggaaccaacaatggcgttcccaaggcaattgggggaatcaacaaaatattttaaattggaataataatcaaggcaacaattggggcaatcaaggtaattggagcggaaacgagaataattgggacaacaacaacaatggtgggcggaataataatcaaggaggtaaccaaggtaatcgggggcaaggctttcaaaggcctctgatgtaccaacaaccgaacaacccgcctccgtttcaatctcaagggccgagctcttcaggccaagacctgggtagaattgagaacatgtttgaacaaatgataaagaagaatcaagactcggattcccaattatcctcccataatacttcaatccgaaacttagaagtgcaacttggacaaatatcacaatctctcaacactcgcccgaagggtgcactaccaagtgatacggtggcaaaccccaagggtgggcacaacaaccatgttatggcggtgactacgcgtagcgggagaggtagtggtgtgcaagaaagtcaagttagggttaatgaggaggagttgcaagaagatgatgttccattagtggttgaagatattgttgaaccaagtgtgagaaatgaggtgtgaattgatatcgatgagggtgaggaggagacccaagaggctgtgaacccgtctagggaacacgttattgacatgcccaaacatatggtgccaaaagctaaggcacctatgcctagccctcctccaccatatcctcaaagattagccaagcagaaaggagacaatcagtttaagaagtttattgagatgatgaagagcttgaccatcaatgtgccattggttgaggctcttgaacaaatgtcgaggtatgctaagtttatgaaggatttggttactaagaagtgatctatggagtgtgagaccatcaaaatgacacatcaagtgagctccattgttcattctataatgccaaagctagaggatccaggcgcatttactattccttgtacaattgggagtaccaattttgctaaagccctatgagatttgggggcaagtatcaatctcatgccttattttgtgttcaaaactttggggatcagacaacctcgtcaaacttctatgaggcttcaagtggcagaccgatctataaaaaggcctttgggtattattgatgatgtcctcgttcgggttgataagttcatattgccggccgatttcgtgattttagattgtaaagtggatttcgaggtgcccattattcttggaaggcctttcctagctacggggaaggccttggttgatgttgaagcgggagaattgactttccgcgttggagatgaaaaagtggtattccatgtatgcaagtccatgcgacaaccaaataccaccgaagtgtgctcgtttgttaacattgtcacggcggtgatagtggatgacacaagcgccatggcgaatgttgaggacccattagaagccgtgatcttaaacatggatgctgatgatgttcctgaaagggtggagtgtgtgaatgcaattcatggcatgggttcgtattcatatgatccaaggaagctatctcttgatcttgagaaccggaaaactccacccaccaagccatccatcgagaagccaccggtgttggagttgaaacaacttcctcctcacctcaggtatgagtttcttggtcctaatttcactttgcctgttattctttcttcttgcttgactaacgtgcaggttgacgccaccttggcggttcttcaaaagtgcaagcgggcaattggatggactttggccgatatttggggtattagccccgcgttttgcatgcacaaatttatcttagaggatgatgctaggccttctcttgaacaacaagggatacttaatgaggctatgcaagaagtggtcaaaaaggaagtaatcaagtggcttgacgccggtgtggtgtacccaatttttgacagttcatggacttctccggtccaatgtgtgccaaagaagtggggaatgacggtggtgaccaatgataataatgagctgattccgactcgtactgtgacaggtaggagagtgtgtatggactactgaaagctgaacaaggtaataagaaaggaccatatcccattgccgttcttggatcaaatgcttgaccgtgttgcgggccgggcatttgttgttttctagatgggtattcagactataaccagattctcattgcctcggaggaccaggaaaagacaactttcacatgtccttatggcacattcgctttctcacgaatgccatttggattatgtaatgctccggcgaccttccaacgttgtatgatggctatcatcaccgacatgggggaggatatattggaggtcttcatggaagactttagtgtggtcggggattcgtttggtgaatgtttgcaaaatcttgatcttgtgttggcccgatgtgaagatacaaatttggtgcttaattgggagaaatgccacttcatggtggaagaaggaattgtgttgcgtcataaaattttgaagatggggattgagtttgacaaacaaaaaatcgaggtgatctcaaggcttcctccccctaactatgtcaaaggggtgaggagttttcttggacacgcgggtttctaccgaagattcatcaaagacttttctaaggtagtgaacccgttgtgtaagttgttggagaaagatgcaaagtacgtatttgatgagaagtgtatggaggcctttgagcttctaaagcaaaagttgacgactacccccatcattatctcacccaactggagcttgccctttgagctcatgtgcgatgctagtgatgttgcggtgggggtagtcttgggccagaaaattaattgttccatctggtgtactattctagcaagacgatgaatgaagctcaaagaaattacacggtcaccgagaaggaattgcttgccattgtatttgccatggagaagttttgcccgtacctcatgggggccaaagttattatccataccgattacgccgccctaaggtacttgatgactaagaaggattcaaaagcaaggttgatgagatggttgcttcttctacaagagtttgatttggagattgtggatagaaagggtagtaaaaaccaagtggcggaccacttgtctcgattggaggaggaagggaggtcgcctgattgccttgaaataaatgattcttttccggatgaacaacttctctcagtttctattcttgacatgtcgtggtttgccgacattgcaaattatttggttaccggtgtggtcccgtatgagctctcttctaaccaaaggaagaagctcaagcgggatgctttggacttctattgggatgagccatatctcttcaaaatttgcaccgatggtgtaattctccggtgtgttcccgaagaagaacaactaagtattgtggaagcttgccattcttcgccctatggtgtccatcatggcggggcaaggacgacatctaaagtgttgagttgtgggttttattggcattcattattcaaggatgccggtgactttgtaaaaagatgcgatgagtgtcaacgtgccggaggaattttatggggccatttgtgagttcttatggcaacacttatatcttgatagcagttgactatgtgtcgaagtgggttgaggtcgtcgccctgcccaataatgaatctcatattgtggtggctttgttgaagaagagcattttcactaggtttggcacaccctgtgccataattagtgacggtggctctcatttttgcaaccgagctttcgattcttttcttgacaaatatggggtaaaccacaaagtgaccactccttatcatccttaagcgagtggtcaagttgaggtttcgaactgcgaaatcaagagtattctctccaaaacagtcaatgcaaataggaccgactggtcaaagaaattggacgaagctctttgggcttatcgtatagctttcaagactccgattggtatttcgccatatcggttggttttttgtaaatcatgtcatcttctagtggatttggagcataaggaaatgtgggccttgaaaaagttaaaattagagtgggataatcaccgggttgaatgattgaatgaacttgatgagttccggtttcatgcatactccagatcgtccttgtacaaggataagatgaagtatctccatgacaagtatgcccgggggaaagaattcaagattggtgatatggttcttctcttcaattcccgattaaggttgtttccgggtaagctaaaatccaagtggagcggtccttttgaagtggttggtgttactccttttagtgctattgacctcaaaaacaagaatggtgaagtgttccgggtaaatgggcatagggtcaagcactacttgggcaagtttgacgatatccccgtggtggcgcttcttcacttgaaatgatcatgatggtaacatgagtcgtgccgcgacattaaatcaagcgcttcttgggaggcaacccatgtcttttcgttttctttgtttttctgttgtagtgcaggatttttgagctgatagtttgtgaagtgtgcagggctgatgttgaatcggtgcaagacaaaaagtgaaaaatgcacagtctctaaacagtgcccacgcggccgcgtaccataacagtgcggtccgcggggccttgttaaactggaggtgtcaactcagcagacccagcgcgaccgcgtcccacttttatgcggtctgcgctggaagaattaaaatgtggccctctctaataaatgtcccacgcgaccgcgtaccaaagaagtgcggtccgcgtgggaatggccaaaattaactaagtctctgaagtgtcccacgcggccgcacaccaaagcagtgcggtctgcgtgggctgagctcatgttatgaaggacaaaaatcctgcgcggtccgcgtgccacttttgcgcggccgtgcaggtaggtgagaactgggccccacagttgtctataaatagacgcctagggcctcctttaacccttttagcaaatttttcatctgagctcacaaattactgttcgctcacacaacatgtgcacatattctctcatctccattaattcctggtaacttcttatcatccactttaattcatagttaattatttgctaattttctttgcattctactagtataacttcttaatttcttcttctttcatcttagttaactgttaggatagacttttgcttactctgagtagggacacttaggatccttagagctaaaaatttgaactgagttgtgcaaaaaggacctgcccagtctcgtgccctacgcggccgcacaacacttttgtgtggtccgcatgggtttacttggcatttttggaaccctctcagcgcgtccgcgtgaccacttctgtgcggtccgcatgaagcccgcgtgaccgcgttccaaagcagtgcggactgcgtagccagaggttcagagagttagcattttgggtagttgatctgagcggactgcgtccacttttgtgtggtctgcgtcattcctatacggccgcggtccgacgcggccggggttcagggaagtgaaattttgaggcttaaattgtgcggaccgcatccatttctgggcggtctgcatttatcctacgcggccacatttcaaaacattgcggtccgcgtaggtcctttctgtaaaattgctggactgttttgcatgtgcggtccgcgtggacttgtctgcaacatactgtctgcaactgtgaactgaagttctaaactgtctgcttcttctccttttatgcttccactaacaattttagacttatatctcttgcagacaatggctacaaaagcaaagcaaatacaacgtgggggtaaggaccaacaacctgggtggggtggtacttcccgagggaggacgatcagaagggtactgaaactcgctcccaaggacaaagagcaaatgaagagaactagaaggattattcgggaggtagacagggttgcctctaattcaacaggcagtgagtatgccccctcccggagtataacttcagagtccatcccctcgcgcatgtccgtagaggttccggcaccagaatcatcttcttcggagcaggcaaatgtggccactacaaagaggccagtaaatatggtagtctcagactcgtctggtgagtccggggcttaaaaggaagctgatgaacaatattccacttcccccgtcatttcatcatcaggggagagtgagggtggtgagccaaagattgaggggttggagagaacgaggaaggaggaagtttgggaagattgatttgtaagtgaggtcgctttccaccagtatagggattggtggcccaagaggaagttgataatggagcgttggtttattgatgctgacttgctccctcacaaccctcacgtacaagctcaattccgtatgagagacggttgggggttcttcacagaaaaggtggacttggcgaacgaacacatgatgaaagaattctatagcaatgtataccatgtagttcagggctccacagctacaaaggtgagggacaaggtcatattgtcttatgggaaaacgctcaatgattttctggggtttgcagatgaggatgagtcccagtacctagagaagctagctatgaaagaggaagttcgtccatggtcagccgagatcttagctgctcttggtacagttcctgcgcggttgaatgcaccggcaaagttattcagaaacaccctcaattttgaagcaaaagggtggttggcctacatgtgcaatcggcttgatccaaccactcacgaccattccattcccattaagcaggccatcttggttgcttccattatggcgggatttccattgaatgtgggcaatatcatgcagaggctgattgctaccgtggggaatgaaacaaacacgaattaccctttccccaacacattgaccctgtatttcaatgacatggaggtgaaagaaaagaaatatgatattatggtgcctccggtgagcccctactcttggtatgatcagcagggtcctgacaacccaaagaaagctaagcagagtcggcatccatttcagcagctggccagtctgaagagatggttattgagcagccccttgagccgaataccaccacattgcctccaggaccatccacaacacctccttccactttagttgagccggtgattccggtgtccaggactcacagattcaccacccaccagctcgcacaatctcttgccagtttgattaactggatgtcgggtgcgacatccaagttgtccacattatccatagttgtccaggctcagggagcaccattgactgttgaggtccctgcctcaattgatgagactttgaaaaaaatcctggccaaccaggaaaagatgatagcagagcagggaaacttggcaaaggcagttggagagcatagcaaagccctcacagtcttggctaaggagcataggaagttgaggaagaccaaagcctcaaaggactcagtgaaggagcttcggaaggatgttgacaagctcctagctgatcatatgcctgtggacttactgttcgaggaccctagtgaggatccagcagacatgcaaccacaggcagaggagaggaggccaaggaagaagaggaagctccctagcacagagggagtagtcattgaggtagctcccgctccggagggcccatccggtattgaagatattgagcctctttcagccctagaagtagatgagccatctcacgagcaggcacctgatgtcccagtagcacagcagcagcaagctggggatcggtctgaggtccttgccagtacagaggacacgggagccatccaccagcagagagctactgatgtggcttgaggggccatttctatatcctttacccctattttgatactttatttgatagttagcattgggtacaatgctagcttttattcgtgggggtgtggccctaattttttatttttattgattgaatgattgtatatattatttaccatcggtacattcgtagatatagattggtttgtatataaatcttgattctgaactcccttagttgtatattctacttcccctgtgtacatattcatttggtctttatttgaggtttctttctattttcattaaaaaaattcatttttagttgcaaagttaggctcgtagcctcttttttattttgtttgatgttgcaataagcccttggttgtcttaatgcacggttttttccaagggtagaatgtcgtgtgaactgggtgattcttccaaatgatagatagcgtgacatctttcttaagggttgagtcagtttttgcttttcctttttgattttcaagcttttcgtaattaagagtacctcaggcaaaacttcacttgggcctagcacatttgcctttgatcttatggtcgaagacatcaagttgtgtttaggatggtgaaagtcgtggccttgagactcttgtgttgaccaagcaatcatcatatggtcgtgtgggccttgtgtgtttaaatcatatctaaggtcgttgtggtccctcgactccgtctttggcaatccttgagtgtacgtgtggtgagaactcgatttatgagcccaagtaccgagccgatggtctagaagttgccccgaatgtttgttgaggtgaaatcataggtggaacttgacttgagaagttattgtaggctcttcttgatccaaaaatgttatcttgaccaatttcatgacctaccaataaaatgatccctagttcacccttttgagccttgaaaccttgttctttcaaaccaagttataagcctatacccgttctcaagtaaaccttctcttggcacccaaatctttccttgagtagtggcgaatgtttatgtttgggggggggggggggggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggggggggagacaagaaaggaaaccatgtggtattaggtacaaaagcaaaagaaaaggaagtcaatgaaaaagagaaaacgacaaaaaggaagtcaaaaagagaataagaatcaaagagggaatcaaaggacaacaaaaagtgaaaaaggtttaaaagtagacaaaaggagaaaaaggcttgaattgcaaaagaaagagtaacaatgtgtatctctaatcccttggaagaggtagattacccatttgagtcaagaaagtgtgccaaagcaaagaaaaagaagtgcttaagggaagattgaaccaatgtgaacaatagcatatcctacccctacccaaaagccttcacaatgactccccaaaagtcctacatgatcttgagttaaggaaaacctacattagtggatacttacatgaagggcaagcatatgctacttagagccggacttagggtctcttctttgtgagtgctgagtgagagagacttccacctcgatttgtgtgcacatattcaaaaaggtgagattcacttaggaaagttgaggatgcgtgagtttgggttccacaatgaccaaagtacatgagataggttccttgatgagatgtgtcaactcttgaggctcttgtgtcacacttgatccacaagttttcaaagttttaaatgtgttaatgaagcattcgcattgagggcaattgttagtcccaattgaagcttgttgaggttactttaggacaaacaggaattactagggtgttttccattgaggggtaggtctcattttattttcttgaggacaagaaaaggtttaagtttgggggagttgataactatgcattgtacatgttttacaccccttcttacctgagatttgtgcataaattgctttgaattagtcctgaattggttacaagttgcgcttgattgcaggttttagcgacaagatgataaaaattacaaaatcagctcaaaaaggagtgaaatctaccaagtgtcaacagatgccataaagtggggaaataagtgacctacgcggaccgcactgttctggtgtgcggccgcgtaggaaggttcagaggataagaattcaccaaggccacctacgcggaccgcagtgctttgacatgcgaccgtgtaggaaaagttcagagagatggaatttttgaggaaaacccacgtggaccgcaaccatttctatgcggtccgcactgatagatgttcagaggctcacagattcaaggcacaaggcccacgcggcagcacaccaaagcagtgcggtccgcgtgggtacaagttcagagaaccagcaagttggcaggtccttctgtgcggccgcgcaccatttccacgcggtccacaagattcagcctgcgcggccgcgtggcatttccaggcggttcacatccctttatccagaggcgactgaagtgaagacaaattgccctacgcggccgcatgccacttctgtgcggagagcgccagaccctcagggtatttttgtccggtgtttcctgtgtagtataaatagaacactttactttttaggttatgttttgtcatctgtgtagcagctgagtacgagatagtttatattagcctactttaggcaattttctcttgtaattaacgtggattcaagtagattaagctagtagttaatgataatgttgatttcttctagtatttctgctttttctacttcttccatgtctagctaaacccattagctagggttgtgactcaatcctagtatggttaattaatgggtgtttttgcttaatacttggatgttattgggtgtttggtatttgggttgtttgtatgtcttcacttagatttggtggttgcaaacaccaagtcaagcttagtgggtcttgactcttcttgagaaagagagtctatgacctcacaatcaacccaataaggatttgggatggacccatgagaatggtagtcccaagtaacgggttaaatctcgagagagtaatttccccacttgaaccttgtgttgcttgggcaagttagcctacccaattggtctcgagggagtcaattggacaaaatcgttctccttaccgaggggtatgagagcgagtgctaaaagtgcagcgtttatccatagtccccataattagcatccttgtgttagaattttatacttgttaattagccacctaggtgagtgttcaccaccctagtgcctttctcttattgcttacatctagtatcaatatcttagcataattttagttcataatagtagttgataattttagttgttaacaatagaaaaatccaaaaatgatagaagaccaattagaagctagaacgcatttctaagccatacaaatacgcaactccaatttgaagctctctgtggaattatcgaccccgatatcattattgggttattagtattcgcgcccactctttcttaggattgagttcgacacgatgaagctgcagggtgcccgctgacctcgactctcattcctttcattttgtactgttctatatattttcacacaatgttttgtcggtcggatattattatcatttagatgctcatgtactcagtgacaccaggttttgggagtgtattgtatctttaattaagaaatttcttttaaaatcgaattatttggttctcaaagttaaataaaactgtgggaagattattggcttgcctagtattgagataggcgccatcacgacgggttagattttgggtcatgacacggtcaaacttccaaaatcaaattttcgttttagccatttcaagcctaattgaactacacactttcaaaaaaaaaaaccgaacatgctcctaagtccaaaataaccatacggaactattggaatcatcaaaattctattccgggtttgtttacacataagtcaacatctggccaacctttaaacttaacctttaaactttgaatttcattcttccaacagacttcaaaatacatgaaaaccaaatccaaagattcacatatgtcctaatacatcataagaagatacttaagacttcaaatagttgaaaggagtgtaaatgtgcgaaacgaccggttgggtcattacattttcccttacttaaacatacgttcatcctaaacgtgctaagagttgttccgaaagccatcaaaccactgtatatacttaccaggaacatacactggttgatcccgcgtcactctatcctatataggtataatacaccacataactgaaatttcttaattcaacctgtcccataagccttggaatccaattttcaatgttcgaaattttccataagatcagaatcttgctctacacattgtataagtctgaacaagttgtaccaagctataaccataactcaaataccacataactcgatgctcgtagcaattttttttcaaatcacaatagctgcccaaattaacccgataccaatattaaactacatattaaacaacacgtcattacaaaaccttcgtatattgtcggtaatgaaaggaacatgtggaattacctaatcccaatcagataaacaaatcatagagctctttcgtttcaatcagaaccataattactttccaggctgaaattgatattatcctccctaatacaccataatcaaatctgatagtacacattctaggtccgatggcattatattatcaaacacaacaattcttcatacatgccacaccaatataactcaatattgcaccatccgggtacccccaaaaagggaaaatatctcaaagaagagagtcgttttgcaagttcaacaagcaccacaacaacgatatgttatgagctcatcaattgtagtggaaccaaaacacacaaatcgaattaacaataaccatcgcttctagagatcacattaacataaaccgcatggcaacccagttaccaataacataatccacctggcatagcatagcctaagcatgttcccaagcatgaatagttgcctcggtgcttacacataggttcaaacctcacatatatgcacactcacatcgcatagttatcaccataaattaatgcaactagtgcctccaccaagtttatataaaattctcaaatcgaacatgtcgcaaatcccaaaatagtatactactgagaactcccactctccaaattcatagatcacataaatcgttgtaactgatcacaacctcgacactcaaatgaatagcacaaccctcaagcacgatcatcccacaattaatattttcataattctcctgtgctacatagaaaaaatttgaatgttagtagtcgatcaaccatgtgagtactataataccaatgaacatccgttaatcaaaatataatgtgcctttttaaatgtgcacccttcttagggattgccgagtagttttaacatccatctgaatatctgaaacttactattctatgcagaattcgttaccttcccttcaagagtgaactgccaacttgtacatgaaaatcttaatcccacacaacacaccatgtctatcatgccatcatgcggcagacacaagaatatcattagaatttctgggctacaggaaaattacatatcgggcagttagaaaccttctattttttcccatcgaggaagagttcatatatacaatatgtttctcacatcggtagaagatatccggctcaaaccatggtaaaaacccataaagaataccttgaagtttattagcacataaccaactaatcaaaagtgaagtcctctaacttgaccaagtcatgtggatcgcaaaaccaatgaatactgccaacaaaacctctatagagcctcaccacatcatgagtacaccaagaaccattcatatccaaatctcactaccagagatcccaacataaaaccacatggccctaaggcccataagccgtcgtattcttcttatgcatacccgtgagtaccacaaccgaagcgcccattctgaaagtaccttaggtgaatttaaaattgtactctacctcccttacactggaataaagaatccgcagtcatacagaattaccgcaagtcttagcaccacccaatgtaaataattggttctagagtatacaaatcccaaaaaatccaatatctacatacacattttgaatccattagaattgtctcaagagtcatctaatctgctcaaatctaaattgcgccgcccaacaggccaaatgacacatgccccattgtcacaacaacactcaaagaagtaactctgccttaacaccactggtcgaattttattccatgcacaatacattttttgcaatcaacaactcagtcatttcatgatttttcatatactcataaagcataatataacccatatttcgaaatttcattattctagtcttttgcaatcttaaccactgcaagtcgtaactaaccacgagtatgcctcacaccaaaacctaaaattaaccatgaaatcgaattgtcaatagcaagctcccccacttggctcaaagccatatatccaaacattcaaaaattctcaatacccatattcatttactgctataacaccgaagtgcgacttaactgaattcttcacaagctcatgcaacacaacctatatggttcctcaaattgcctactaagctcgacttcattctcatgacggtcaggtcaattttcttgactaattcaaattcaaatctcaatgcatctaccccatgggtcgaaaagagaattctccatcattgtagagatcatacctccatagtttattctgcatgtgataacctgcctgtttagcctcaaactgtcatctttatacaccctttttactgccacaactactacacaatcacttaacccttctgagtttgaactcatcaacaagacatgaaaattttaatttgtcccataatttcacaacatgaaagatccttcaacatattcataactcgagactctatttcaaatcaagataggagtcaaatactcaaaagtcccttctttttttgtcactttcaaaccctcagaacacatcccgcagtcatctcatactcatcataacaccattcagctactcatcgagccataaattttcacttataaagacactaccagacacttaagtccaacgcacaagttttaacaattgagactatcgagcctaagttgcggtctacacctggcctcaagtcctccagactagacctttaccgaaacacataatacacatcttgaatctcgttcatggaaccaaaagctgtcgaaagttgatcctcatgtgcgcatacgaatgcgtggaaggaattcaaaggattacgcttcaagctgaatcaatgtcgcatgataaggaaacaaagatgtgaagtatatcctaaattccttatagcctatcgaaggtaagtatggatgaaatcatactgatccgcaagactctactagacacttgcttatgacttgtagagcctatgaacccagtgttctaatactaatctatcacgaccaaaaatccactagtagtgatggaacctaacccaatccgctaggtagccaattaaaaattatccatttctaattaacttaatcaaattagttaaacaaagaggtcttctgaatcttatacattcccggggactcgtactacaaatcatgagcttctaagaatagcacttacaaagctgatatgaagaaaataaatcttttatttgaaaagtacataaactgattttatacatctaaggttaccatgaacaagaggcagctacaataggaatgcaggtacatattcaatgctaacttccgccatgcacatcaacatcagtatccgaaatatgcatgcaatgtgcaggtagtgtagtatgagtacaatcgaccccatgtactcaataagtaacaaacataaacttaggtctaaagcagtgacgagatggaatataggtcgggtccaacaccaatattcaataacagttcataaaaatgtaaatcatgtaatgaggaagtaactcagagataaagtgtttaaaaatcaggtatttccctattcgaaaatcgttttcacaacaaataagatgtttcattttctttccaaatatcaagtgtgagttatctctctatgaccacatatcaatatgtgtaaaaatgtcttgaatgaagtgatgctatgcaatatgagggaaaatacatctctatgcttgtatatcatatatgcatgccaataccatgtatatcagagatgaagcatgtactcacactctcagagtactcaacctctctatatcacacattccactcatcataatcaaccactgagtactgtatatatcccatccgcccacggaagatccatcccggaatatatacataactgactataagtcaccagtaccaaggaaaaacaggcaaatctagcctcacagagaagatccatcttcgggtatatatatacaaaaatgatcaaccattcatcgccgtataatactcatcgtagcatgcaacacgatccatatatatagccataagactcgttgcggcatgcaacaagatccattaatttataattaattgcgcttactggggtgtgcagactctgaaggggctcctacaacccaatcgctaaaacctgcaagaacaactcacgtgctgcacggataactcacgcgctatcatatacctacgcttattgggggtgtgcggacacctggaggggctccttcatcccaagcgctataatccacacagataactcacgtgccacacggaaaactcatatgctatagtatcaatatcagtatctgcacggacaactcacgtgttatagtatcaatgtcagtatcggcacagacaactcacgtgttgcactgacaactcacatgatatagtatcaatatcagtatcagcacggacaactcacgtgctatagtatcaatatcagtatcggcacggacaactcataccctatagtatcaatatcttacaacccggccctcggcctcactcagtcatcaatctccgcagtctcattcacggtctcacaatatcataaaactagtccgacaacaattgatatgatgtatcaataattaacaattgagactgagatatgatatgaatgcatgaatatggctgagtacgaaatatcaataaaaatagtgagctggcagcaagaaacgaccattatggatccgaacaatatcgataaaaagcctaaccataatatctaacatgattgacaactcatttattttatcacatggtgaaaataaaaatattaatataatagggccactattcagtgcctaaaaataatgaagtttcaactcatagggtgcacgcccacattcccgtcacctagcatgtgcgtcaccttaatatctatcacataacacataattcggggtttcataccctcatcactaatgtcacgaccaataatcctggtcgtgatggcgcccggccgcaaggctaggcaagcccgaccaatcaacccaagtatggcattacagcccaaaagaagcaatttcaaaatcaaacagcaagatttaatatcaaactcccagccagggataatttataccaaagcaaacacaactgaacaataatcctcccaaaaccgaggagtcacgagtactgagcctctaaataatactaatgcactgactgaaagagaatacaagtgtttgacaaagcaacaaggagataaactagaagagacagagtaaacaggttcttcggacgctggcagctacctcgatactctggtaagtctggaatagacagcagcaacaactctatgcctcaggagcacctgaatctgcacacaaggtgtagggagtatggggtgagtctatcaactcagcgagtaaggagcatgtataatacccgaaggtgagaaatccatagaataacagaaagtaaagctatctagcagttgtatacagtacgagcctcagagataaccatatacagtaacagataataaatgtatgaaatgcaatgcaatgcaatgcatgaacactacggcgtgcagcccgagccatccatatgggtacccgcgctcactgtgggggttcagactccggaggggctcctacagcccaagcgctatatcatatagtgccaatagttaccacttttttcattagaatacacagtgccagtagttaccaccgttccatgaatcatatacagtccagaaaatagagatataatgatcgtcagcccgaaatatcatttaaaaccatttgagttttcaaaacatcaaagtacggctgagtttgcaaaatagtgttcaaaaccttggattgaattcaagtaatattcaaatcatgataattttgaaacaacgatccctgaaggattctacaagtcagcacaagaccccaaacatggcatcatgcctagatatcatcaatatagaatgcgaagcaatcgccaacacagtatatatatccctcggattgaaccgagtcacaattccaaacatatatgacgccgcactatccatagagtgtgtgtctcgcctcataatagcgtcacaatgtgatataccggggtttcaaaccctcaggtcatcatctacacccattactcacctcgaatcgacgaaaactcaagctcacgatgccttggcctttcaattcggcctcctcgcgcgtcgaatctaaacaaaaacatagcgaatacatcacaatatgccaatgggacaatacccatttgaaaacagtcgagaaatagcaaaaattttgaaactagcaaaacccgagcaccggacccgcttctcgaaatattacaaaacttacattttcggaatcctcgtctcgccacgagtccgtaaatataaagttcatcagaatcggagtccaattgctcctccaaattcccaatcttcatttcaaatttcaagccccagttcttcaatattcttacccaatttcagagaattaatagatgattcttcgattaaatgacgtattaaggtcacgatacttacttccaatcacttctcatcgaaatccccttcaaaatccatccacaagctttcaaggtagcgcaaaaatggtgtaagaatgactcaaatcacggatgaaatgtcttataaaaactctctgtccagctaaacgaacctttatcgggaacgcggagcccacccgcgaaagcgaaggtcaactgttttctccttctacgcgaacgcgtctgcatacccgcgagcacgaagacctggtcctccatccttacgcgaacgcgtaccgtccacgcgatcgcaaagtgcaacagccctgggaccccaactccttatacgcgaacacgagggccctaccgcgaatgcgatgcactgggccactgccctctttgctaacgcggccacctcttgcaaacgcgtagaccaaaatctggtctgcaactgaaagctattttctgctacaatttcaaggttcacaacctccgtttaaccatccaaaatcaccccgaggcccccgggacctcaaccaaaagcaccaacacgacttattacctcatttaaacttgctcgggccataaaaacactaacgtaaataccaaaattctcagattcaactctaagttaaacatgaactttccaaaatcacattcgatgccgaaaccaaccaaacaaagtccgaatgacctaaaaattcgcacacatatccaaattcacctaacgaagctactgcaactctcagaattccattccgaccctcagatcaaattctcgcctatcaaccggatttcttcaaaattccgacttcgccaaactaggctaactttcacaccagacctccgaattcattttcgttttctcttctaagtcataaatcattcatcaaaactagtcgaaccatcgaaaatccattccgagccctctaactcacaagtcaacttatggttgacttttccaattaagctttccttaaagagaatatttgtctcatttctatccaaattcaaactaaaacacttcaaactcaccaaacacatatgataacacctgaagaagcataaaacgggaaaaacggggcagaaatacaagagacgacgggtcgggtcatcacaactaagtttaaaagagttacttatctcaaaccgcaaaattctttactctgctatgccctttccacgtgaaccagcctccgaacgccttgaatctagtcacaattaatttgattcaatcaatacgaattatagtaatttattccatatgaaaatacctatttttcaacaaatttgaaattagctcaaaaattgcccgtggggctcacatctcggaactcgacaaaagttatggaatatgaatacccatccaaccacgagttcaatcatacaaatttcaccaaattctgacatcaattagaccctcaaatcttcaattaaaacctttgaagatttctaccattttcaacccaatctttgcccatttgaactaaaaaatcttcacacaaactttatttgtacgtacatgtattaataatacacttacacctaagaataatacttttcatgacctatttttaatcaaaatcccacaattgaaaacatagggtatgaaagcttacctcttttatgaagatcttgagggatttcttgttggatttcaaggcttggacaagattttgatgaacaacatacttcatgtacttcctctctctagaacactcttatttctctctaaaatcataagataaaaaccccaaattaagcccaaaagcctatttatcaaaatggggtcgcaccctccgaaatcaagtctgcagtcgcataatgggctgcagaacaggtatgcgagctgcaaaatcattgcaaacatcggtgactagtacagggctatactggtccattttgtggccctttttgcggctgcatgtcaattaagcggactgcataatgattctgcgattgcaaaattgacgaacggtttaaagtgttagaaattagactcagaggtctttcatttgataggtttacattacataacacctcatataaatgtagatatgcccgtccaaagtgtggtcttatgcgtattcatttggagttttagttgatcatgtaattttccaacttggcttaaacttaggcaccttctaatgcccaaaatcacttataatatgcctcgtacacttattatcatatccaattgatatccatcataataaataatcctcatctacacccaaaataatataattagcatacgccgacttcttattagcgcttaatgataccaagaacttccaacttttatattcgatgccgaaacctatcaaatcatgtccgattgatcttaaattttgcacacaagtcataaatgatataatggagttatttcaattacttgaatctgattttgatcctgatatcaaaaattcaactacccggtcaaacttccaagctcaaattttcgttttagccatttcaagcctaattgaactacggtccgaacatgctcctaagtccaaaataaccgtacgaaactattggaattatcaaaattttattcttgggtcatttacatataagtcaacattcggtcaacctttaaactttgaatttcattcttccaacagactttgaaatacatgaaaatcaaatccgacgattcacacaggtcataatacatcataagaagatatttaatacttcaaatagttgaaaggagtgtaaatgttcgaaacaaccgattggatcgttacacacacataatctcttattataaaaatcaaagtagaaatgaattacctataagagctatttgatcactgcattttatataatgcagttaccaaatttttaaacacatgcctaaactaagttcttggtactcatattatttatacattgaatcaaggacaacatgaatcataccagttaaaactaacacaaaacttcacctgctggataactatgatctttagaaaattcctaaactttatcacataaaataaacacgaatattatatctaaatattgagcttttgccttttccctggaatctgtcttagtggaagagtccaacaaataataaaatgtagatggtacgaatttatatttgattgaaaaatggttgataataaattgagaatataaatatagaaaataatgaaatcacataatggaagaatactaatgtgatgacccaaaaggtcatctcttatttttgaagtcaaatctatgttccaaggtcttaaaaacctcattttgttttatctcaattttcaggcacagtctgagcgcatttcggaaaagcttttatgtgaaatttaagaaaaaaattgattttaaccattaaaatttattaaagttaacttcgctcaatattttcggtaaacagacccagacccatgattaaacggtcctgtgggaaacgtattaaaatatgggacttgggcgtatgcccggagccaaattccgaggcccctagcccgagaaaagtatttttaaataaaattatttgctgcaaaatataaggacttttggaaatgaaatggtatgtgttcttgatggtatcgggcccatattttagtttcggagcccggtacatgtctagaataataattaagtcgaatatgtaaaatttgggaagaatcggagttgattttgtataaatcggacccttagttgagaaaatggaaatttcaatgttcttaagaatttcatgaatttgaggtaacttcgtagttgttgatgttattttgatgatttgatcgcacgagcaagtctgtatgatgtttttaaacttgcgtgtatgtttggtgtagagccccgaagactcgggtgagttttggataggccacagagtgattagaacttaggaaaactcagctgatgcatctgatgttttgcacaggcctctgatctcgcaattgcgagatcaggcttcgcattgcaaagtgaccaggcctgggaaatgcgacaataatgtcacaaatgcaaacccggcttgggtaggctatcctcgcaaatgcgacattttggccggaattgcgaaggccccttatatcgcgaatgtggcattttgcatcgtaaatgtgaaggtagcagaaatttatggggttcgtaattacgaatccctgatcacaattgcgataaccacagcctgttaagtgagatttcagatggaattttcattatttttcaattctcctcaaaccctaaacatccctaggcgattttcaaagacccaaacttctccagatcataggtaagtgatttctaactcatcttcatcaatctaattcatctttttacatgatttcatttcaaaatctggtgtttttcatgggaaatcgggtgttcttgggtagaaattatgattttcaaaatttagggatttggacctcaaattgaggtcggatttcaaaaccaattgcatatttgggtgaatgggtaatcgggttttggttcgaacttcgtgttttgaccaagcagacccggggtcgatttttgactttttggggaaaagattgggaaatctatattcatgcattagaattggtttatttaggatttattgatattattaagtaaattatgactcgatacaagcggattggaagtagaaccgagaggtaaagcggtaattgaggcttcattttgtctgtggaattgaggtaagtgtttggtttaaccttagcttgagggaataggcattttgttcttattttctatgtgttagtgttgagtacgacgtatatgtgtgttgacgagtatcaatacgttagtttcaagaatgcccgtgagtcttgtaccatgattattgtgactcatattatgtattgtctatgcttaaattgatgattatcaatgttgaacaaggcttatgataatttctttgtaattgttcaatgttgagtctggatcaagttgagagttattttgtgaagtaaccgttgaaactagattggttatagctgaatcccttgtccggatgtatttgtttttactattgattcccttgccgagatgtattgtttctattatttgggtgaggaagagtgtaaaacacgaagggcgatgtcgtgcatgatattgcgactaagtgttaatgtaggaagggtgatgttgtgcatgatattgtgagtgttaatgcacgaagggtgatgtcgtgccatgatttgagagctaatgcacgaagggtgatgccttgtcgatattgtgagagttaatgcacgatgggtgatgtcgtgccatgattatgagagttaatgcaagaagggtgatgttgtgccattttagttgtttcttatggtgaggatgagagtaaaagtacgaagggtgatgttgtgcacgtattactgtttcattattcttgttgatacaaatatggtgttcattatgcttctctattggattactattagaacttggtattccctgtagcatgttcccattcccctctttatatgttagttcctgttattattgctctgttcgtatatgattcaattgcacatgtttataaggttgtcatgtcctagcatcgtcactacttcgccgaggttaggctcaacacttatcagtacatggggtcagctttactgatactgcactctataccttttgtgcagattttggtgctggaccacgtgagtagatcgtgggttgctgccttcagtccaggagacccgaggtagatatgccgacgttcacagactccgaagtcccgttccatatgttttagatatattatctcttttcatttcgagaacaattttatttcctttacactaatgtttgtagaaatctttggatttttgtgatattgtgacaccaggtcattgggtagccttgtttcagaacttaagttgttatggaagttccaaattttttacatgcttagctttatttgcaattaattactgtttgggataataatcaatgtgttagaatgtatcattggcttgcctagcttttaagagtaggcgccatcactatcacgacagtgaaaaattcaggtcgtgataagttggtatcagatctctaggttgcctacgtctcacaatttatgaacatgctaggtagagtctgagggatcggtacggagacgtctgtgcttatctcccagtggctacagagtttaggaaaaatttcatatctattatcttctgttctgcgacttgatttatcaatactaattgaacttacactctattctttcgcagatggttaaaacacgtaccgctttatcagttgaccagcagcccgagtcctagtggcagctcctacgaggagtggaggccgaggtcgtgctagaggacgaggcagggccaaggctcagcctagagctcgagcagcagcaaatccttaggaagagtttgaggaggaggttccagcccagacagctccagcagggccatctcaggttcttgagggtttcatcgccagcccagtactccaagatgctctggtccgtctagtgggcctaatggagagcgttgttgatacccaatttttccctaggtatttttgtacccaaaatgctttcaaaatgacatatatgtgcatatatgagcatacccaggtgttttggtaatttcccaaaattttaaagattttttaaaccaatttattatctattttaatactacaaaattcaataattatttccaaaattattattttagtgaataattcattttactctcatatttatactaaaatatagtttaaataaattttgcacatttttacgcatttatttggcattttgaagctaaattgcatataattgcaattatagcctattttacgattaattgcattttataatattataaaatcatttctaatatttttatattaatatttatacattattagttagtttagtattttttaatccattttaaaatctttttcactatttttataaaataaaaagggaaatttggctatttaaaatctggcccgtttttatttcaattatagcccaaatagatccccttattaacccaatttcagaccagtccaactccaattaaacccgaaccacacctaattcaactactcgatccagccttgattcgatctgagtcgttgatcaaataagatcaacggcccatatttattttcctaaattaaaactaaatgacccacccctccaaacccatcacttcagactctctctctactaacgtttgctcttccttctctctagaaccttctggttctctctctcgtctccgatgaagccactgcctctccggccacctccatcctcacttctttcgaccaccagccaccatggaatagtatcttgattgagtctctctagcttcgagacaccagaggcttcaaaccatacaagatggtcaccggaggccatgcttggcttgtcttcagccattatctgatggtttatagtccgatggtactacgaatgccattattctttgtgttttacactactctttactcaatttcatcgattactcatgtttttaacgttttgttcttcttttcaaaactagggtttctgaaaatccttttcttcaaaatgcttttctggttttaagtgtttaaccctatgtgtaaatgagtctttattgattttgttaggttcttccttaaccttaatcatcctatgctaaacacccccccccccccaattttttgaaactttgttcggattctgcactcgtccgtgttatttgatacatgcatatctcatgtgctttgatttatgtgattacttctttgtaattaggatatcatgtgattttttgccctactatgcctgtatcaaggtttcggattcgattttttccgtttatgtttggtttatttgtttatttatggaaatctatgttattttccctaaattagtgttgtttcgaatccttgattcactgaattgttatggtaatacctatgtactgattctcgattatttccatgtattttgcaaccttaattagttttttactttatgttgattaatcgtgttacttattgattcttcactaatggtttccttaattgaaccctggtgtatttacccttaattgtctacgatgtgcccaagtcttacttgatcttctttccttaaatgtgttatgctctttaccgttggctagttaccccttaactaacggaagacttgttgattccttttgcctgactgattttgtggtttccttgattgatgaaaactatttcctttaccttattttactctgctctaaactactatatgtactctcctctcttctcacttccagacacgaacaaaattcattgttcttaactctctcttacacaaaacatactcggtgttctctcttgtttctacacaacttctctcactttccttgtgactactgattactcagtcggcttaaagcatagattgagtgatttaggatgctttacaggtctacagttctttacattgctacctgctttggtctgcatactgctgctcacttctctgcatactattgctcactattgctctatactatctcatcctcggctaatatgccctccatttgatttacagctcacaaaacaacatgtttttatacatactgcactttattatgttccttctatgcttttacttgtggctctgttgttcttattgcaattagtatggtgctgtgttttgttcatccttctcttaacctagctttcctattgatttgctccccttccataatcagcatgtagtcttgacccccttttgtttgaaacatggtgtgaccgtctaagtttttgaaatattacttgtccccatcccccttttcctgtttgtgtttacttctctgaagtatatgtgatgttgtcagaattatcatattgtcttctttcaaaactgcttctgtatggatcattctcctaaactatttttttcaactctttctttttatttaaaaaaaaaactctgtcacgctctcactactcctagagtttaggtcctacccccttcgtgtaagcattgccttgggtacctcttgagcacccattgaactttgatacataaggctggtaattaaacactgcacttgttcaatgtttgatattatttgggtactggtattggccaaggaccacaatgggtccttagggagcttagccgcacccaaaccatggcaaagggctgtgcaactcgaaataagtgaggttggaagaattgggcctggttgaaggctacttatagagtaacttcttattttttctttcattatgtaattcagctatcattgtttgtattaatttgtgaacaactaatggggtctatagtgaaatgggtggggattatgcatgttttggtttaattgatgggtagataacatgtcgatagggctttaccttacttatttgtgcaatagaaaccatttgtaggacatgcatttttgcatatagatatcttgtttaggctctttactttcagattattatactcacctcgtaatcaattagtaattacaaacaaccatttttttcttaaaatatttgctactgcatttcgagaccatgtttaggagcttgtgtgcattagatatcatgttacataggacttttgtttcatctgggttgtaattactgagcgcctaactagttgcttatttaataacacaaatttgggctaaaccgcgtcttctctttaaagctggattaatatgcatgttcacatttaaggtaattaggcaatgaataggacacctaggcaagctttaggtctaatcaattaatcacgcgtctgattactcagcctctttaactgatgaactacagtccttgttaaaaatttattctgttaaaactccagtcccattttcgtgcctctgtttttcaactgagttgtttacttgtccagaatcgtgctgctagcaggttacagcaaaccctattactgtattattggagtatgttttaaacaatgtttacctatactactacaatcttttgtttctgaaaatcgaatcttcttcaaggcacttaattttaaacattagacttcttctgcaacttatcttttctgaccttccagtttttaactcttttagaccttaaatgtgtttgagacgtgctaactgcatgtttatttgtagagggatttgtgagcctttcatttgcttccttgcattattccttttatgtgtagtcctacttgttatgaatggcgcctagtattttgtcctttaaacctaaggattcagcctagtccttacctagtaagaatagtggtcctaatactctctaggacttataggatgggatgggtacatcacgcaataagcattcgtgaccaatccacatgtttatataacctttacggggtggggaagggtagaatatggatatgatgaccggtacgctaatatcacatgcgacccctcttttgaggagtgtacgccagttattgcatcgatgtgatccatattatttgtaaacctaggacccccttatcccttttacttgttattttttcttaagttgttcataccatctctctaaactttctgctcctttatttttcaaactctcaacttgcttgcaatattacgtgaaaacccctctatttgagacttctatttgcttacttgttattcaaaatcacaattgtaacatggccgggaccacatttgtggatcttgaggggtgcctaacaccttcccctcaagataatttctaacccttacccgaactctggtttcttcatctcacactctgcttaaaagtgtcctaatgcaatataatcattaggtggcgactcttcaactcctaaacccaaattctcgaaatggaatagagttgtcctcccaaatgtcgtaaacccgatttcgactcttagaaaaagggggcatcgacagcatggcgactctgctggggattttctttaggctttcaccattgcatattatttgtgactttattgcttcattattgcttttacttaaatgtcattatctcttcttctatgaaacttgtcacaccccaaaatccgaggagcgcggccggcactcgaccgggtatccccagtcaagcggacctgggtgtctttcctatcccacgtgttgcccccgaatttccattacttattaaccaaatgaattagccattcatgattaaaaacatacgtagtcactaaatgaagtttacaacttacatcgcccaatatacaaaatacatatttacataagttcacaacccacatttactgtctacggagcctctaaggatacagaaggatgatacaatacctgccggtaacaaggctccggctatacctttcactaaaaatcaaaacaaaactccgaaataaaaagcggcatgagccacacaaggccccgagaggaaaggggctcaccaatacatctgatggaaagtgaaggggagctacagtcggtggactagattatctgccatgaatccacctacaatcataacacgaatgtagcgcccccggcaaaagggacgtcagcacatttgaattgtactggtatgtatgaacaaaccttgccctaagtaaactcaaaacaaacacaagtagcaagcaataacagaatcaacaatcgaatacacatttaaggaacaatcaagccaaacaagtttaccatatctcattcttccccttcaacattatcacatcaatgatttcacatttccttctcagtaataaaatcaacgatgaaaacatcaaccaaacacttcacaatgaaagattcaattagccaaacaaacgggcaatcagtgccccacaggtttcaaactctcctgctgtctcctttcacaactttcacattaatcatttcacatttgtgatacatttcaatagtgatatcgaattactttttcacccttattacctcggccacccttattacctcggccacccttatcgcaccaacccacaccttatttcaccgtgttgtggcgtgcaacccgaccccgcctgacagtttccaattcacaaatatcacaacaacaacaattcacatagaacgacaacaataattctcaaagagaaaccacaacaattcacaagaatttttgtagccatcaataccatttccatcatattcaacaactcatgtgcaatttaagtcaccacaataattatccacaacaagccaaatatgatactaccacagttgttccaattgcataatttacgacttccttccattatttgtttctcatctcttaccacataacactttcacaatcaagcatttagtatattgccaattacttgcaccattacatcttgaggctcaaccacaaatactcaaatcaaaccaatcacaagaatttcacaaatagtccacatagatatcacataccaaataatcgtacaccaaacaaggtgactttacaaaggtcacagttagccatacatacctcgattgagctttcctttaattactacgatattccggaaattcaagcaattctaatctactacgagacataacaaaattaagcatatattagaaagatattcactattcttgctcatttgagcattttatcaaacactagatgagcatcttgattattaaccctcttttacaagatttccttctttccccaacccaatctttacctatttatattcatcaatcatcccacaattctaatttgaacatacatctatacataatacaattataccaagaatcataccccaaaaacccatctaataatatctacaacaccaacaaaacctaggttaggcacatacggctttcaatcataacccatgagttctaatgtatagatcttccatgaataatcaccatagagtagttagagatgatagacatacctcttgtagtaaggattttaagaatcctcacttttggtgttcttgaagaattcaaagatttgaaggaaaatctaaggatttgaagattaatccatgttagcataagtatttaggagtagtaatcaactcaaaatactccaaaaatcttaccttggatatgggaggagttggaggacttgagagagtggaagaaaaccctcaaaatttcattcttgaatgtcaataatgaagggaagatgataccccttcggtttttacatagaccaggggtattttaaacattttacatgggttcccgcggtcgcggccgcggtcgcgggcagtgagctccgtggtcaaacccgcggtcgcgctcctgggcgcgctggtgactgatgtccagtaaaatggtcataactttctctatacacctccaaatgacacacggtttgttgcgttggaaactagactcaaagggatttaatttgataggtagatactcacacaactccttatataactggagatatggtcgttcaaagtaaggtcatgtgcgcactcattcacagattttgtctaatctgaaattttccaactgggcttagacttaggcttatccttagaccccaattcacctctaatacaacttatacacttattaacacatccaattgatatccataatatcctaaatcctcatttgcacacgaaataaaatagttagtctaccttggcacgacgaaatctcaaattactaggaaaacaattttccggggccttacattctccccccttaggatcattcgtcctcgaatgaggagtagagtctttcccaaacactttaacatcacacatctcttttctaacctacctcaagtctctaaattttcactaactcccaaatttttcagaaatttcggcagagtctcctttgtaactaagcctatccacctgtcagagaaccacttaaaccatccctaaaacacatcctcaactcgacaaagaaacccaatgcatatatcgacaatactaatctcacaattacacgcactatattatcataataatacctaaacatgtactgcacatttttaaatcacaacacttataaggtacctttcaaatcaaaaccaattgttatacaatcaaacgaaaatattttctttccacgacactttcggccttcaatgtggcctcctcgacttacaagccttaccacaacccatttgcaaaaataattccaatcttcaaacttacctaaaaaggataataactagatacctcgcataatctaacagtccaataacttcacgttcaatagtttccactgtacaattacatttcaccggatatttcaattcatggcaataacaaaaacccacaattccttcacatagcatcataccatcaagaatgtcatttaatagtaaccaaacaatcatgtgttcatattagtccctaccagtcattaatgtaatcacaaaggtgttcatcaacaagaacataatttcatttcaatcaaccatgcatatgaagtcaagccacgataattctttctagtagtgaattatatagtatattaccatgatcatatagttcaatcaaatccactcacacccctcttttaccactaccttcttagacataagcatattaaaacatataatacatataaaacaacgatggtaattatcatactcattgcatggcttacagtgaacaacacttaagcaaccttcattatcaactcacctaacatcattagtgaaaagtattaagaataacccattcaccattcaaaatctaaatctctacatttatactcacactaaactattgattacttttaacaatcactttaggatgtgctatcataaactgacgataaaattacctatcgaatatatgggataacacggggatacttcttctttgacatgtttgaaccttcaatacccaatagatctaatacggtaaggaacaacagagttcaagattgggcttggaattattcaagaatccatttaagcactgacaagagcatttcatgaggttacatgctaagagacacgagggtttctattgatgatgctgacatggttactcattgtgaagacatcaactattaggcaattaaggaattggagtaactcataccttggcaatagtaaccattaaggaggaatattcaagtacgtgacccagtcgtttcctggagtgtagggaaaaatccatttatcaagaatgagaatattctggcaccttgaatacgatcggggttcaaaatacatgaagttgaattacactcttaatgttgactgacacaaggaatctatgccactagcccacgaggatgaaaagaagttgagcacttatgggcttatcatactttgaatagcttaacccctcctgataattgatcttatatgagagaagtaaagatgcaataacttgtcttctaaatcaatatgctcatgatatgtgaaaaaaatctgaaagcatctaatctcaacctttcacaagtgaaaccacgtagctaggatatcttgacatgggaagaaatcatgaattggttagatggttctaatagttaaaatgatgctccgggaaaaaggcaaataacaatcctgtccagccaagtaagtgagttaccaaaggtagaaaactcccggtacatgaaaacgacatagtgaatgattctagatgtttgagagtataaagacaaccaaactcaatgagacaatgcacaataatcctagaaggtttacagatgttcacgatgatctctccataggttttgacttgaaaaaggaagtgtcatagtgacacatagaagggcacgttctctcacggttattgaataagtgttgggaactagcactgtcactttcatcaactaaaaatcacagttaacatatgttatggagatgtaagagaaaacaaccattggttacaagatggacatgcttctactatgttaactctctgactgcgattcaagaccacatcatgggcgaccacaatactagaaaccaagtgagacactttccatgggataacctaagtggataagaaacttatggcgacacacaacttcctgtaatggggatgtgtggatctcaatttttttttttccagaaaacctttatgaacacggcgaccatttcgattgataagcactcatatgataggtgttaagctatgctcttatattactagactttgagaagcttccatcatgatactcacaagagagtagattgggtgctcaaaccatataagccacatgcacaactgagtaaaagagtgactcaagaaggatcgcaatacaaggatgctttacatgaaacttgacatcacataggtaaactttacgacggtacatgtataggcgtgagtgagtagattttgttcatttagaaaggaaaaggaaatcgtaagctttaaacaatcacaacattaccaaataaaaaggatcacccaactttcacataattctcatacctctaggctgcattttatagcccttccatagggcacatatcaaattatatacctatgtgtttcactaaataataaggaaatcataagtacaaatcaaatactttaaatgatcaccacattatcaaataaaagaatcatgcccttttcacatatattagttcaccggcacttggaaccataattgtcacatcctcattggcattaggccacatttcataacacaatctcttctttcccacatttcacatcattttcgcatatttcacctcaatatcaattcgtaggaacttgaggccacaattatcatcatacttggcactaggccatatttcataactcaacctcttttttttcccccatatttcacattagtcccacatgtttcacatcaataacgtacaatttcaaaaacaagtcagctattcaagatatgaagtacacatgagaggaatcacgaatcctcggcatatacaatatctcataaatcatacacctcaagtttattagcaatataactttaaacacaacgggttctttcaaatggatagaggggatacaccaacccgcaatagaaacatccatcaaaggcataaacaagcaattacaccaattcttcttgaatccttctttttcaatcatgacaatatataatttcaacatctctacacacagagaattttacatagtttggcataatacatgcaactcattctcaatttaaggtcttagcatcttaatacatgattcatattccttgcaccctttctaatttatcaactatagcacattggtcattttggaatgcatcttttacaattatagggtcacaacaccatcatgtagagtttcaatcacaacaagaatccaacattcagtcgtgccacatttatacagtcacttacttcacttccaaacatctttgtacattaccaaaaactaggtacaatcaatcaaatacatttggtacacatagaaacaatttggaggatcaaccataacgagttttctcacacaatttggtatcaaaatctcaatttaaacttgacttgcagtctagccatttttagcacatagttcacattcttcacatattctcatttaccaagaataacatatcaaacacatgaagaagtacccaccacatatattttcacaacaatgattcccttaacataaccaaatgagtattgcatcaattatatttgggacatacaacgtttatgcgagcaccattgaatctcgatttctaaaaggtggggttttaaccgtacatactgacgatatactacatgatatggtggtacaatgacattagttggaacaagggtactctccttaaaaccaagttctaccaatcactccatggctcaacacattcttctaacaagtccttgggtaatccactcggactcaatggtgggataaatccctccttacatgcttcaaattcgcagagtatggtatcaaaattaccaatcttgagaataatacttagagaggaaattagctccctatcttgagccatatcgcacgatctggaatgtcaaagaagggtgaaattcctaaatgtccaaatagcctccaacttatagatgtggtcgacaacacaccgataagaaggactctactagacacggctccgagacatcctaggacactttaaaaccttaagctctgataccaagtttgtcacgccccaaaatccgaggagcgcgaccggcactcgaccgggtatccccagtcaagcggacctgggtgtctttcctatcccacgtgttgcccccgaatttccattacttattaaccaaatgaattagccattcatgattaaaaacatacgtagtcactaaatgaagtttacaacttacatcgcccaatatacaaaatacatatttacataagttcacaacctacatttactgtctacggagcctctaaggatacagaaggatgatacaatacctgccggtaacaaggctccggctatacctttcactaaaaatcaaaacaaaactccgaaataaaaagcggcatgagccacacaaggccccgagaggaaaggggctcaccaatacatctgatggaaagtgaaggtgagctacagtcggtggactagattatctgccatgaatccacctacaatcataacacgaatgtagcgcccccggcaaaagggacgtcagcacatttgaattgtactggtatgtatgaacaaaccttgccctaagtaaactcaaaacaaacacaagtagcaagcaataacagaatcaacaatcgaatacacatttaaggaacaatcaagccaaacaagtttaccatatctcattcttcccctttaacattatcacatcaatgatttcacatttccttctcagtaataaaatcaacgatgaaaacatcaaccaaacacttcacaatgaaagattcaattagccaaacaaaggggcaatcagtgccccacaggtttcaaactctcctgctgtctcctttcacaactttcacattaatcatttcacatttgtgatacatttcaatagtgatatcgaatcactttttcacccttattacctcgaccacccttattacctcggccacccgtatcgcaccaacccacaccttatttcaccgtgttgtggcgtgcaacccgaccccgcctgacagtttccaattcacaaatatcacaacaacaacaattcacatagaacgacaacaataattctcaaagagaaaccacaacaattcacaagaatttttgtagccatcaataccatttccatcatattcaacaactcatgtgcagtttaagtcaccacaataattatccacaacaagccaaatatgatactaccacagttgttccaattgcataatttacgacttccttccattatttgtttctcatctcttaccacataacactttcacaatcaagcatttagtatattgccaattacttgcaccattacatcttgaggctcaaccacaaatactcaaatcaaaccaatcacaagaatttcacaaatagtccacatagatatcacataccaaataatcgtacaccaaacaaggtgactttacaaaggtcacagttagccatacatacctcgattgggctttcctttaattactacgatattccgaaaattcaagcaattccaatctactacgagacataacaaaattaagcatatattagaaagatattcactattcttgctcatttgagcattttatcaaacactagatgagcatcttgattattaaccctcttttacaagacttccttctttccccaacccaatctttacctatttatgttcatcaatcatcccacaattctaatttgaacatacatctatacataatacaattataccaagaatcataccccaaaaacccatctaataatatctacaacaccaacaaaacctaggttaggcacatatggctttcaatcataacccatgagttctaatgtatagatcttccatgaataatcaccatagagtagttagagatgatagacatacctcttgtagtaaggattttaagaatcctcacttttggtgttcttgaagaattcaaagatttgaaggaaaattgtaacgaccctaattgtcgttccctgtatttatactccgtaaaccccgtaatatgtttccccgtgtgttgatatccgtgttggatgagtttggggtggttcgggtgaaatctagagtgaaatgagacacttagtctctttaaggaaggtttaaattgaaagagttgacccaaagttgactttcgggttagagggctcggaatggatttccgaccgctcgactagttccgggggatgatttatgacttagtggcgaaaacggaagtgaattcggaggtccggtgtgaaaattagctaagattggcgaagttagtattttggagaaatccggttgataggtgagattttgatccgggcgtcggaatgaaattccgacagttgcattagctccgttaggtgattttggacttgtgtgcaaattttcagattattcggaggtgtttaggtcgggtttttgattggttatgcattttgaaagtttaagttaatttggaaattgaattagtgatttctgaggatttttggtgttttcgatagcgtttttatgacccgagcaagtttgaataaggtagtaggttgagttggtatatttggttgaggtcccgagggcctcggggtgaattcggatgcccaacgggcatgtttggtgttgaaatctgctgctgaagtgcagcagaatctgcagaaaaattttggtctctgcgatcgcatagcttgggctgcgatcgcatagaaggaattgtaggggccgagattttgctctacgcgatcgcgtagaattgtctgcgaatcgcgtaggtctacgcgtttggtctctgcgatcgcgtaaggacgaatgcgatcgcgtaaggatgaggcagccagtgctctgcgatcgcgtggcttgtcctgcgatcgcataagaggaatttcaggccatggatttttggtctatgcgatcgcaggggaattgatgcgatcgcatagaagaacgcatcagtgacagaaagctttaagtgtgaagttcatccgtgaacttcactatttttcctccattttcatcatttctcgagagctttgagctgggattgaaggggaattcatcttatatcgattggaggtaagttttatgagtctattacgtgattatatccatgaatcatcataaaaatcactgaaaatcggatcaaaacccatgtttagggctttgagtttcaaatctcttaacgaggatttgaggggtcaaatggactccgattttgatgaaattggtatgtatagactcgggttgagacgagggtcattttgatgtaaaaatttctggatttcgagacgtgggcccggggctcggtttttgcgaatttcgtgaatttcgatatttttcgagtcttttcgattgggttatatcccattagcctaatgctacgtattcaatctgattttgagcagattctacacgcgagaagacaaattcgcgagggaaaggcattgcgaagtgaactttgaactacgtcgaggtgagtaatatcattaaatgatgcactgagggtttgaaacccggaaattgcacattatgatgctatattgaggtgacttgcacgctgaacctgagcgtggggtagagcaccgttgaggattgagacttggtccatccagattactgatgttatggaatatttgataaagatatactgttttatatctataattgggcttattgccgtatttgggatttgtgccaatgaattgaagatccttatgattttttttatatcaatcttcaaattgaaatacattattctttttactgaataataattgatatgaaacaggggtaacaatgaccctgtactatatacttgaacaggggtaacaatgaccatgtatgatacatattgaatcaggggtaacaatgaccctgtatgttatattggaacgggggtaacaatgaccctgtactacataattgaaacagtgataactatgacactgtatgatatacttgaatcaggggtaacaatgaccctgtgcgatatacatgaaacaggggtaacaatggccctgtacgttaaactgaagcaggggtaacaatgaccctgtatgatataaattggtaagatatcaataactgatttttgatatgaatattgagtccgagggacaaatacgattatttctttattgttttaagcaaggaattattttacattaactgatttactgctgcaggtagccttattatgtgcttttgtttggatttcatatcctcagttattatttaattttattaccactgggtcggagtactcacattactccctgcaccatgtgtgcagatacaggcagagctgagcaagcacctgagcgctgattcttccatatcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccccgtttgctcccttatcttttgttattgtattattccagacttgtaaaatattgtaaactctgtagttgctcatgacttgtgacaccccgatttcgggctgagtcgggatgggttttgctattttgtcacgcttatattatcattaagcctttattatctgttaaatattcataagaagtatattgttggttgttggctggccttgtcttcacgagaggcgccatcacgaccgtgttgggattttgggtcgtgacaaaaatctaaggatttgaagattaatccatgttagcataagtgtttaggagtagtaatcaactcaaaatactccaaaaatcttaccttggatatgggaggagttggaggacttgagagagtggaagaaaaccctcaaaatttcattcttgaatgtcaataatgaagggaagatgataccccttcggtttttacatagaccaggggtattttaaacattttacaggggttcccgcggtcgtggccgcggtcgcgggcagtgagctccgtggtcaaacccgcggtcgcgctcctgggcgcactggtgactgatgtccagtaaaatggtcataactttctctatacacctccaaatgacgcacggtttgttgcgttggaaactagactcaaagggatttaatttgataggtagatactcacacaactccttatataactggagatatggtcgttcaaagtaaggtcatgtgcgcactcattcacagattttgtctaatctgaaattttccaactgggcttagacttaggcttatccttagaccccaattcacctctaatacaacttatacacttattaacacatccaattgatatccataatatcctaaatcctcatttgcacacgaaataaaatagttagtctaccttggcacgacgaaatctcaaattactaggaaaacaattttccggggccttacaaaactgacttgtttctttgtttcctttctttaatgctttctttactgctttcctttaatactgttgtaattacgagcaattattataatcattatcttatgaacgtggaaatacatgccaatctattttatttttgtaaattgcatcttcaacatcgtattccactcgtgccaaacaaaataccatagcaacgcgtataatgagtggttgcgctcttccaatattatcacccctaaattgtcaaaggcatatttacggtaaaaccagtcgatcagcggtgcagtcgacggttccgtgcctttccctcttgagttgtccactcaagggtgccagtctaacaccccatagaaaccttactctgttcaactgtacatgcatcatggtcaaacctagccgagtcagttatgttgtccacctaatgactcattaacatagccttgtccaaagtacattgggtttcttggaaacccaaacggataccaccatattctgtgcatttatttggagaactaaatgctttttatgctaattattggtttaaatagtcgagtctggcggggtaggggtctaacgcattgttttgcaaaaatgaggcacgaagtccccagattcggcatggtaaccaacatccacccaaggctactaagctggtgggaagatcttcatgcaagtgatcgaaatctcatccgcaagtacttacgaaacctgccttctcttctggagatccagcctcacaataaaataatagaggctacaactctgttctgggatagtgaccgatccgtgttccactttgagtgaaagtacaagagggggagggggtgaattgtagataattaaaattaatcgtaaataagttgacttaagactttagtagccgactgaatatggcaatcttacaaatagagaaattcaaagtaatgtgcagaaagtaaatgcacaaattaaagacactaggaatttttatactggttcagattcaatatgaatcctaatccagtccccttgggttgcaagggatttctcttcaagtaaatgagttttctttcgagtacagatttgatatttgtcgcctagtcttctagcactcgtttgatacaatgccacactagtcgtacactctctttctatccctgacttgttacgcagcagatctatataggctactatgcttgtttgcaataaattgaagagagttattttggtttgatcaaactatactaaggatggggttgcactataaatttatacaaggatgaatggtgaaggcttgtcaacccaagggttttgatccttggaaagagttgattcttttcaagaataaagcactagtcgttgcttctcttcagatcttttcctttggcaaatgatgggtttgacagaatttttccttgattattggaccttctaatcttgaccgttgtctggatcttcaagatttaattggtctttagtgatttgatctgactcgtcaatcatagattgcgttgaatctttattccattacggcatatttgattttccagaatcatggagttaatcctgatttgctgatgtagtattgtttctttccttgtgcatcatgagtatttaaggcagcttcctttgagaatgatttccttccttgttcgatatagtaattccaatagtttttttttgcttctttgaactcctgtacatgcataataattgcatcattaaaatatgatctaacaatctccccctttttgatgatggcaaaataatatacatagatgtaaagtggtaaacaacagttgacttccctatttaggactggctgacttggctccccctcaatgtgtgtagtcaacgaaacacgatctccccctcaatgtgtaaagtcgacttgtacatgtatattattgtctatgcatgggaagcatagtacttaaccagttcaaagaataagaggtactatctatgcatgtagcatagtctacttgacctgttaagagaataagaggtactgtctatgcatgtagcatggtcgacttaacctgttcagagaataagagatattgtctatgcatatagcatagtggacttaacctgtataacgaataaagagtatatacatagtcgacttgaacctgcacataaagcattaataatccagaagatatatattctccccctttttgacatcagcaaagagggagtagaaataataatatccacatacgaaaaagagaaaagaaaacatccacgggcatagcccaaccatagccaaaacaagtttaaagcaaaaatattgtctatagaccacatccatctcatcgaagtagattgcctccttcaactgttcaaagctggtgttggcagcaatgctcattccatccagcctgtcatgcacctccttaaaggctttaatcacattctcccttaccctttgcacaaccaccctaaatttagacacatctgaccctatttccttagaaatagcatgaatagcatccacagtcaactgtgtggaggacatgagagtcttgatgtctaagagttgagagtcaatagagctgaacttttcacttaggtctacaggaatgggagagggcagaatagcagacgaaggcttggttttcacaagggtttcctttgcatcactatcacccttcttgacccagacacccttgacactcatataccccatactagagaaggctctagagttgtagcacttgtacacatgaatagaggggtagtctgaaagtggaatttgatgagcttccagaatgtgggtgatgaccataccgtaaggaagactggtaggatcttcaacactctaaatcataaaatttatgacctaggaggataacttgattttgagtttggagataagacagtagacaaagaaggtgtccatttgagagagggttgagaaggaaccagttctgggaaggagagtggttgcaacaatgtgaacaagaaccctaatttcaaagctaatatcactggtccctaattgattgggaagggtttcagagggattttctgcaatacactgtttagcctaattaaaggtgattttcaaaatcccctggccaaacactcttaaagataggagagaaaccagagcaacgacagagaaaaagggaatcgagcaatccacaatcaagaacaatgcgtttaccaggaacaagattttcaagcctatcaggtttactagagcgaagtttagcataaaatatacggacaaggggctcatacactttaggcggagaaatagagagaaatttttcccacccttgatacatgaaaagatcctttaccttacagtagagagactccatatcatcgatatctaccactctaccatgggcgatggtcttgtccttgagagaaacaaagaaatctctatttagggtgtcccagaaatttaggtcgtattcgagagaggtagagaaatcaaactttaatttcttaggagtggaagcaggaggatcctccatgggacgcttaccagaggctttgtcacctaaaagttgagagtgttcagagtacgctccttgagaagaggcacaacccttataacaatcaaaaccgaagtgtacttgcttaggaggagcgaaagagggttttgcgtttgagcgggtactttttctagtggaagcagagaggtttttggaagattttaccatggaagaaaagagggttggtacaggttgaagaaggagttagtagaggttgagggagatgatggtgataaaagagacggaaaaggactaacttaaatagaagagatttgacggctgagtacataaaaggaaagggtgtcatatgaagcgacgtgatgatgggatttccaacttcggctgcaaactgatggaaaatagactaaaagagagggaaaagaccgatagcgtaattaatgtactgaaaaagagcaattatgacaagtttttgaaaaataacaatttggtactaagagttttttttaaaacaaataatgccaagtaattctctcaaagaacagaatctatcttccaataatggtttagtaaaaatatgagctaattgggcagaagtgccaacaaaagctaattccatgtcacctttaggaatatgatctctaataaaatgatatttaatgtatatatgctttgctctagagtgattcacatgatttttagaaagacaaattgcaccggaattatcacaaaagatttgtataggtttaaaagaaagttcatagtcacccaattgatgggacatccatagtagttgtgcacaacattgaccaatggctatgtactcagcttcagtagtcgacaaggtgactgatgcttgctttttattgttccaggatattaagacctttcctagtaattgacacgtgtcactcgtgcttttcctatcttttttatcacatgcaaattctgcatctgagaaaccttctaatttaaatgagttagagcgaggataccacaatccatgagatactgtgccaataagatatcgaacaattctttttacagcagttagatatgactccttgggagccaactgaaacctggtgtcacgccccaaatttgtgggacatgaccggcactcgaccgggtatccccagtcaagcggacctgggtgcctttcctatcccacgtgttacccccgcatttccattacttataaaacattcgaaacagtcattcgtgattaaaaacatctttttacaaacatacgtagtcactaaatgaagtttacaacttacatcgcccaatataccacatacatatttacaccagttcgtaacccacatttattgtctatagagcctctaaggatacagaaagacgatataatacttgccggtaacaaggctccggctatacctttcactaaaatcaaaacacaactccgaagtaaaagcggcatgagccacgcaaggccccgagaggaaaggggctcatcaatacatctgttggaaactagaggggagatacggtcggtggactggagtatcttctatgaatccacctacattcataacacgaatgtagtgcccccggcaaaagggacgtcagcacatctgaattgcactggtatgtatggataaaatacaagtagcaagtagcaagcaataactgaatcaacaattgaattcacatttaaggaacaatcaagccaaacaagtttaccatgtttcattcttccttttcaacattatcacatcgacgatttcacatttctttctcaataatagaatcaacaaccaaacacttcacaacaagtaatacaactagccaaacaaaggggcaatcagtgccccacaggtttcaaactctcctgttgtctcctttcacaatttcacatttatcatttcatgatttatatcatttcaatagtgatatcgaatcacttttccacccttattacctcggccacccttattacctcggccacccttatcgcaccaacccacaccttattttaccgtgttgcggcgcgcaacccgaccccgcctgacaatttcaattcacaaacaacaaacaacacaacaacaatttcaaagaatcaacaatgccatttactagaaggtaatcacaacaaagagcaaggtgtttccacaactaacaacaacaatttcctcatgttcatgtttcaatccacaataacaaacaacaacttcctcatgttcatcatgtcgttcatagtttgagttaccacaacagttgttcacaatcaatcatatatgttgttccacaatgtttccgtttccaccatttacgaactctttcaattacaagttccccaactttcaccacaagaagttactacacatatataaacctgaagaatatcacaaataatccacataggtatcacataccaaatagtcgtacatcaatcaaagtgactccacaaaggtcaaagatagccatacatacctcgattgagctttccttaagttactacaacgttccagaaattctagcaattccaatctactatgagacataacaaaattaaacacatattagaaagatattcatattctagctcatttgagcattttatcaaatactatatgagcatcttaattaataactctcttttacaagatttccttctttccccaacccaatctttacctatttatgttcatcaatcatcccaaaatcctaatttgtacatacatctatacataatacaattataccaagaatcataccccaaaaacccacctaataatctctacaacaccaacacaacctaggttaggcacttatggctttcaatccccttcccatgagttataacacttaatccatactcatatttccataataaccccatatatgtaagactaaggtgtaggattacctcttgtagactaaatcttgaaagacaaattttggggcgttcttgagattttgaagaaatcctatgaaatccaatcaaaatcatgttgtatctagtgattgagaagttaaatcaccatgaaaacatacttaaaacttaccttgaagattgggggagttggaggtcttgagagggtgaagaagacccacaatttcgagcttggatgacaaaaatgaagggtaagtgataccccttcggtttatacacggactaggggtgttttaggacttttccagccattcccgcggtcaggccgcgaccgcggccgcggtttgttacagagaggcccgcggtccaggccgcgggcgcgggcctgggcgtgctgctggcgcgtgtccagtaaaatgggcataactttttgtatacacctccaaatgatgcacggtttgttgagttggaaactagactcagagggatttaatttgataggtatatcatcacacaaatccttatataactagatatatggtcgttcaaagtgaggtcatgtgcgcactcattcacagattttgtctaatctgaaaattttcaacttggcttagacttgggcttcttcttagacctcatttcacctctaatacaacttatacacttattaacacatccgattgatatccataatattctaaatcctcatttgcacacgaaataaaacaattagtctaccttggcacgacgaaatctcaaattacttggaaaaattttttccggggccttacacctggcacatttacaaatgctgaacataatatctggtcgacttgcggtcagaaacagtagagatccaatcattcctatgtatttggtttcatcaattagagtaccttgttcgtccttatccaaatttgtagccggacacataggagtcccaattgcttttgcattgctcatgccaaatttttggatcagctccttggtatatttagtttgacagatgaaattccctcttcagattgatgaattggaagctgaaggaaaaatgtgagttcaccgatcatgctcatttcgaattcactttgcatgaggtttgcaaattccttgcacataagagagttagcactaccaaagataatattatcaacataaattttaatgataagattaccttctgttaatcgtttaatgaatagagtagtatcaatattacctctggtgaacccatgatcaacaaggaaggtacttaacatgtcataccaagcacgtggagcctatttcagtgcgtatagggccttagtaagcttgtacacatgataagggaattttgagccttcaaagcctgcaggttgtttcacaaaaacttcctcttttatgaatccatttagaaaggctcttttgatatccattcgaaacaatctgaatcctttaaatgatgcatatgctaacaagatttgtatagactctaatcgagctacttgagcaaaagtttaatcgtagttgactccttcttgttgtgaatagccttgagcaactaatctggctttgttccttatgacttgtccttcttcattcaatttgttcccgaacacccatttttttctgatgacggaaacattttcaggtcggggtatcagcttccatactttattcttgctaaattgatctagttcctcttgcatggctttcacccagcttgagtccttcaaagcttcctctacctttttggctctatttgagagatcatagcaatatttgctttctttttaagggaagccctggtcttcattccttcgtttggatcccgaatgatatatttttgtggatatttagttttgtttctccactcatttagtcgaacagtgcttgtagtcgactccacacgttgttttggagtgttattgctaacttgttcagtcgactcgactacatctgtggaactagttgactcccgtgattttcatttgtcctgaacttcttgggtttgatcttcgtcacctgcattaatgcctttcttgaccaagggattattttcatcgaatataacatgaactgattcttctacacataaagtacgtttattaaaaactctaaatgatctgctatttaaggaataaccaagaaaaatacctttgtcacttcttggatcaaattttccaaggttgtccttaccattgttatcaatgaagcacttgtttccaaatggatgaaagtaactgatgttaggatgcttacctttcaagagttcatatggagtctttttcagaatgggccttatgagacatcgattgagaatgtggcatgtactactcacaccttcatcctataaatgatttgctagataatgttctaacaacatggttcttgccatgtcttgaagatttctattctttctttccacaactccggtttgttgaggtcagcgaggagcagagaaattgtgagtataaccttgatcgttacagaaatatttaaaggccttgctctcaaactcgcctccatgatcacttttgattatggagattggataacccttttctctttcaatccttttgcagaaaacttcaaagtttcttaaggcttcatctttgtgagacatgaaaatcacccaagtgaaatgtgaaaagtcatcattaataacaaaagcatatttcttgcctcctatgcactacaacattttaggcctacaaccacccccgagaagtgtggcctaaaatgtcaagaagtgtagcatttgggcaaaggcaacactttatggctttaggcaacgctttttcgggggtggcctaaagttgcgtaacctttgattattggccacgctttataggcgttgccttagaagccacgctttaaaagtgtggccaataccgggcaaaggccacacttatattttctgatatagccacgctttcgtgacataaggctacacttataaagcgtgattattgtgacataaggctacacttataaagcgtgattattgtcacattataggctacgcttagaaagtgtggcttctagagcaacatttatgattaccaataccaaattgacattccctatggccacagtttctaagcgtggccattttgtctacactacaaaattattttatttgccataattttgtggttaaaaaactatatttgtttacatcaagttctctctctctcgcgcgcgcacacacacacacacacacacacacacacacacacacacacacacatatatatatatatatatatatatatatatatatatatatatatatatataaagcattaatttaaatgataagtaatagaataaaaatcattcaaatgcatatacttgaaataaatttaaacaaaagaaacacactgtactatctatagtattaaagcaatgttggttcaagaagttcactagcaaagacctctataaaaccaaattgtgacgacccaatgaggtcatcaccataaatgctccttattccatgcttcagaggccttgaaaacctcttgagaggttgcctcgatttgcatgcgcagttcgggcgcaaagccggaaagattttctatattgaaaaatgaattcttggcttaaaatgatgaattttgagtataatattgatatagttgactccggtcaacattttgggtaaacgggctcggacccgtgtcggattaatttctgtagatccgtcatgaaatttgggactcgtgcatatgcccggaatcgaattccgaggtcccaagcccaagatatgggaatttttgtgaaactagcttttgaaattttcttaagtatttgaaaatgattaattgattgttgaatgtcgtatcgggctcttatatggcgtttaagcgctacctgtaaaatttggttgaatttggacgtcgtttgacgtgtttcggaccctaagagcaaatttgaaagtttgaagtttaaagtttggaaattaaggattttgagggtcgattctatgtttttgatgttattttagcgatttaatcgcgtgagcaagttcgtaggatgattttgagtcaatgtgcatatttggtttagagccccgagggctcgggtgagtttcggataggtgacggagggtgtttggccttaagaagtgcagcagatttgctgctgctgtcaggtactggtttccttctatgcgatcgcataggcttgatgcgatcgcatagagtaaaaatgttaggatcagagttccttctatgcgatcgcataggcttgctgcgatcgcatagtgtaaatgtgaaggcccagaagttccttctatgcgatcgcagtccttctatgcgatcgcatagagcaaatgcccagcccctctgtttccttctatgcgaacgcaatacccttctgcgttcgcgtagcacaagccagaccccctcaactttccttctatgcgatcgcaatccctctatgcgatcgcatagagtaattcgcccagtgatttttataaaattccagaacactatatctcggccatttcacccatttttcactcaaactcatttccaaacatctccattaacaaaaatccaagcttccaaccttcacaactcattgagtaagtttactctaacttatttcctttattatttcttccattatcattgagtttcctctctttaattcatgtgtttaagctagaaatcaaagtttttggggttagctagggcttatgagattttgggtatttcaacctcattttgaggtcgaaattagaaactaattatatatttgtactcgtgagtgaatgggttgtcggaaaatggttcgaacctcgagttttggccacgtgggcccggggtcgtttttcactattcatggcagaatagtatgcattgcgtttttggcaatttgggttgttttgttgagtagttattgatgatattgaaccccttatgtatagatataattgaattggaggcgaattcttaaggaaaggcattgcgagaggcttgaattgctagatttcggcacttgaggtaagtgtttgttctaactctagttcgagggattaggactaagaaattatttgctatgtgttatatgggtcggtgtataggtttggtgacggttacctatgcacccgagtcaaagcacgaccgtgggtctttacttgagattgttgaaagctatgatatggactctagctattgagatgattcttataagtaaattgttggatatgaaattcttaaatggtataattgaatagttaaatcgaaatgctacgcctagaaaatgttggaatactatgtgaatattgtgttctttgagatggaacttattatattgaaatgggatcgtgtggcacgccgtccacttattatattgaaatgggatcgtgtggcacgccgtccacttattatattgaaatgggatcgtgtggcacgccgtccacttgtgatattactatgggatcgtgtggcatgccgtccacttgttattatttattatgggatcgtgtggcacgccgtccactttgtgcatattgtttcactttgctcattgttttattttgagtaatcttacatattaactgcttagcttattatgtctatgctttagaattgtataccccttacagcatgctccctcccatatttctctattccgtacatttattatcttgcacaggtttatgcggtaggtctggtttagcctcgtcactacctcgtgagccggggttaggccaggcacttacctgcacatggggtcggattgtgctgatactacacttctgtgcccttttgtgcacagatccgggagcagcttttggagcatatcagcagtagacgggaagctagctttcagatctgagactgcgaggtagtccaccggcgtccgtggaccatccagtcttatctactagttttagtttgtttatcagttcagacagactttattatgtgtttcatttcagacctttatttgtagtaactcttagaagttcgaatgctgtgacactgttcttgggtagggaattgtatcagatttcttccgcgttttgtatttatgaaagtatttaaagtcttccgctaatttttatgccttttaattattaattgtaaattgtaaattgataagagtatgttggtttggcttgcctagctccgacagtaggcgccatcacgatacccgttggtgggaaaattcgggtcgtgacaagttggtatcagagcactaggttacatgagtctcacagcttacggacaaactcggtagagtctgagggagcggtacggagacgtctgtacttgttccccagaagctacagagttaggaaaatctcactttattcattcttgtcgtgcgattctgtttctcaatattgattgtctctctactctgtttcttcgcagatggcgagtactcgagcttcctcttcttctgatcagcaggccgatgccccagcagcagttccagctaggggcagaggacgaggccgcgctagaggccgtggcaggggcagagctcggcctcgagcggcagcaccagaggtagagccccagattgaggttgaggaggctccagcctcagctgtgcctatggtcattccgggtcttcaggaggccctagctcagattatgtcggcttgttctggcttagcccaggtggtctaagccaccgctgcagcagccacctcacagattgggggaggtaatcagacccccgttgctcgcacaccagagccagtggcacagggattacagactccagaggcaccaccagtacaacagggtgccccagcccctatagttgtgccagtgcagacatttattacgggccagactagtgatggtgcggcgatgtccgcggattccttgtggaggcttgaccgcttttccagattatttactcttaccttcagtggtgcaccttctgaggatgctcagaactatctatatacttgtcatgagactttgaggactatgggtattgtggatactaatggagttgattttgccacttttcgcctgactggatccgccaagacttggtggagggatttctgcctatctaggccagcagggtctccagctttgacatgggatcagttcgcggagctatttctggggaagtttctccccgttactcagagagaggctcttcgtcgccagttcgagcgtctacaacagggatatatgacagtcacgcagtatgagatgcggtttgtggacctggctcgtcatgccttagtgttacttcctacagagggcgagagggtcaggagatttgtggatggtttgcatccggatatccgagtgcagatggctgtgagcgccgatggtggtctatcttttcaggaggcggcgaatggcgcccgccgaattgagttggcattgtctttgggaggcggtactgggtcagataagaggccccgtcgttctggtcagttcagtggtacctcgtctagaggtagagattcacatgctaggggccagcccccgagaccatttcagtcagctctccaaacttctcagggtgccccaggtgggcgtggttcacagactcagtttttcgatcagcagttgtacagttatccttccgcacccatcagtgcaactccagtgagatatgctcagcagactagagcttgttacacatatggtgatacgtggcacatagccaagtatttccctagagcttccagcagttcaccgcagcaaggaccccgtcccatgattcaggcaccacctgccccacagcctgcccagccagctagaggcaggggcagaggtcatagaggtggaggcagaggccttagaggtggagatcagccagttcgaggcagagatcaggtagcggcggaccctcctagggatgctattcagggaggtggggcccagccccgttgttatgctttgccagccagacttgaggcggaggcatctgatgtagtgatcacaggtactattttggtctgtgatagagatgcttcagtattatttgatcctggatccacatattcctatgtgtcatcatatttcacaccttatttggctacgcctagtgaggccttgggtattcctgtccatgtagctactccagtgggggattctatagtggtggatcgggttcatcgttcctgtattgtggtattcaggggtcttgagacccgtgttgatttattattgctggatatggtggattttgacgttattcttgggatggattggttatctccttatcatgcgatcttggattgtcatgccaagactgtgaccttagcattgccggatatgccccgactaaagtggagagggacccctggtcataccacccgcagtgttatttcttatgtgaaggctcgacgcatggtcgagaaggggtgtctagcttatttggcttatgttcgcaactccagcactgaggtcccgtctattgattctgtccccattgttcgggagtttcccgaggtgttcccttctaatttgccgggcatgccgcccgacagggacatcgatttctgtattgatttggtgtcgggaactcagcccatttccattcctccttatcgcatggcaccgccagagttgaaagaattgaaagatcagctccaggaattgcttgagaggggtttcattagacccagtgtgtcgccttggggtgctccagttctgttcgtgaagaagaaggatggttccatgaggatgtgtattgattaccggcagctgaacaaggtaacaatcaaaaacaagtatccactgcggaggatcgatgatctatttgatcagcttcagggcgcgagtgtgttttccaagattgatttgagatcgggttatcaccagttgaggattagggcgtctgatgtccctaagacagcttttcgtactcgctatggccactacgagttcctggttatgtcatttgggctgactaatgccccagctgcatttatggagttaatgaacagagtgttcaggcctttcttagacttattcatgatagtcttcattgatgatattctggtatactcccgcagccaggaggaacacgagcagcacctcagagtggttcttcagactctgagggatagtcagttatatgctaagttttttaagtgcgagttctggttgagttcagtagcattcttgggtcatgtggtttcttcagagggcattcaggtagacccgaagaagatagaggcagtcaagaactggcctcgaccagcttcagctacagatattcggagcttcctgggtttagctggctattacagacggttcgtagaggggttttcatccattgcatcccctatgaccagattgacccagaagggtgccttattcagatggtcagacgagtgtgaggcgagctttcagaggctcaaggcagcattgaccacggcaccggtgttggtattgcctacgggttcgggaccgtacacggtctattgtgatgcttctcgtattgggcttggtgcagttttgatgcagaatggtaaggttatagcttatgcttcgaggcagttgaagatccacaagaagaattatccagtccatgatctcgagttagcagctattgttcatgccttgaagatttggaggcattatttatatggtgtgacatgtgaggtctacacggatcacaagagcctccagtaattgttcaagcagaaggagttgaatatgaggcagaggagatagttagagttgttaaaggattatgatgttactattctatatcatccgggtaaggccaatgtggtggccgatgcattgagcagaaagtcagctagtatgggtagtcttgcttttattccagttggccagagatcgcttgccatagatgttcaggccttggccaatcgttttgttagattggatgtttcggaacccagcaaggttttggcttgtacggtcgcccgctcttctctatttgagcgtattcgagagcttcagtttcatgatccccatttatgtgtcctgagagacacggttcagcgaggaggtgcgaaggaggtgactttgggagacgatggtgtattgagattgcaggggcgagtttgtgtgcccaatattgatggtattcatgatttgatcttagcggaggcccacagttctcggtattctattcacccgggcgccgcgaagatgtatcaggacttgagacagcattattggtggcgtaggatgaagagggatatagttgcttatgttgctcggtgtttgaactgtcagcaggtgaagtacgagcatcagagacctggtggtctattccagaggattgagcttcccgagtggaagtgggagaggattactatggactttgttactggcctcccaatgactcggaggcagtgtgattcagtttgggttattgtggataggctgactaagtcagcacacttcattccagttgctactacctattcgtcccagaggctagctgagatttacatcagggagatagttcgtcttcatggagtgcccgtatctatcatttcggatcgaggtccgcagtttacttcctgtttctagatagccttgcatggagagttaggtactcgggtccagatgagcacaacatttcatccacagacggacggacagtccgagcggacgattcagattctggaggatatgcttcgagcctgtgtcattgactttggaggctcgtgggaccagtttctgcccttagcagagttcgcctacaacaacagctatcagtccagcattcagatggctccttatgaggcgttgtatggtaggcggtgtaggtccccagtcggatggtttgagccgggagaggctcggttattgggtgttgacatggttcaggaggccttggataaggtcaagatcattcaggacagacttcgcacagctcagtctagacagaagagttatgcagaccgcaaggtcagagatgtagctttcatgattggagagcgagtattgctccgtgtgtcgcctatgaagggcgtgatgagatttgggaagaagggcaagctcagccctaggttcattggcccgtttgagattctggagcgagtgggagaggtggcttataggcttgctttgccacctagtttatcagctgttcatccagttttccatgtatccatgctccggaagtatcacggtgatccatcgcatgtcttagatttcagctctgtccgattggacaaggatctgtcttatgaggaggagccggtggctattctagaccggcagattcgacggttgaggtcgaagagttttccttcagtgcgtgttcagtggagagatcagcctcctgaggcttcgatctgggagtccgagtcagatatgcggagccgttatccacatctgtttcccgactcaggtacttctttcttttgtccgttcgaggacgaacggttgttttagaggtggagattgtgacgacccaatgaggtcatcaccataaatgctccttattccatgcttcagaggccttgaaaacctcttgagaggtttcctcgatttgcgtgcgcagttcaggcgcaaagccggaaagatttctatattgaaaaatgaattcttggcttaaaatgatgaattttgagtataatattgatatagttgactccggtcaacattttgggtaaacgggctcggacccgtgtcggattaatttctgtagatccgtcatgaaatttgggactcgtgcatatgcccggaatcgaattccgaggtcccaagcccaagatatgggaatttttgtgaaactagcttttgaaattttcttaagtatttgaaaatgattaattgattgttgaatgtcgtatcgggctcgtattttggttccgacgcccggtacaggtcttatatggcgtttaagcgctacctgtaaaatttggttgaatttggacgtcgtttgacgtgtttcggaccctaagagcaaatttgaaagtttgaagtttaaagtttggaaattaaggattttgagggttgattctatgtttttgatgttattttagcgatttgatcgcacgagcaagttcgtaggatgattttgagtcaatgtgcatatttggtttagagccccgagggctcgggtgagtttcggataggtgacggaaggtgtttggccttaagaagtgcagcagatttgctgctgctgtcaggtactggtttccttctatgagatcgcataggcttgatgcgatcgcatagagtaaaaatgttaggatcagagttccttctatgcgatcgcataggcttgctgcgatcgcatagtgtaaatgtgaaggcccagaagttccttctatgcgatcgcagtccttctatgcgatcgcatagagcaaatgcccaacccctctgtttccttctatgcgaacgcaatacccttctgcgttcgcgtagcacaagccagaccccctcaactttccttctatgcgatcgcaatccctctatgcgatcgcatagagtatttcgcccagtgatttttataaaattccagaacactatatctcggccatttcacccatttttcactcaaactcatttccaaacatctccattaacaaaaatccaagcttccaaccttcacaactcattgagtaagtttactctaacttgtttcctttattatttcttccattatcattgagtttcctctctttaattcatgtgtttaagctagaaatcaaagtttttggggttagctagggcttatgagattttgggtatttcaacctcattttgaggtcgaaattagaaactaattatatatttgtactcgtgagtgaatgggttgtcggaaaatggttcgaacctcgagttttggccatgtgggcccggggtcgtttttcactattcatggcagaatagtatgcattgcgtttttggcaatttgggttgttttgttgagtagttattgatgatattgaaccccttatgtatagatataattgaattggaggcgaattcttaaggaaaggcattgcgagaggcttgaattgctagatttcggcacttgaggtaagtgcttgttctaactcttgttcgagggattaggactaagaaattatttgctatgtgttatatgggtcggtgtataggtttggtgacggttacctatgcacccgagtcaaagcacgaccgtgggtctttacttgagattgttgaaagctatgatatggactctagctattgagatgattcttataagtaaattgttggatatgaaattcttaaatggtataattgaatagttaaagcgaaatgctacgcctagaaaatgttggaatactatgtgaatattgtgttctttgagatggaacttattatattgaaatgggatcgtgtggcacgccgtccacttattatattgaaatgggatcgtgtggcacgccgtccacttattatattgaaatggaatcgtgtggcacgccgtccacttattatattgaaatgggatcgtgtggaacgccgtccacttgtgatattactatgggatcgtgtggcacgccgtccacttgttattatttattatgggatcgtgtggcacgccgtccactttgtgcttattgtttcactttgctcattgttttattttgagtaatcttacatattaactgcttagcttattatgtctatgctttagaattgtataccccttacagcatgctccctcccatatttctctattccgtacatttattatcttgcacaggtttatgcggtaggtctggtttagcctcgtcactacctcgtgagccggggttaggccaggcacttaccagcacatggggtcggattgtgctgatactacacttctgtgcccttttgtgcacagatccgggagcagcttttggagcatatcagcagtagacgggaagctagctttcagatctgagactgcgaggtagtccatcggcgtccgtggaccatccagtcttatctactagtttcagtttgtttatcagttcagacagactttattatgtatttcatttcagacctttatttgtagtaactcttagaagtccgaatgttgtgacactgttcttgggtagggaattgtatcagatttcttccgcgttttgtatttatgaaagtatttaaagtcttccgctaatttttatgccttttaattattaattgtaaattgtaaattgatatgagtatgttggtttggcttgcctagctccgacagtaggcgccatcacgatacccgttggtggaaaaattcgggtcgtggcacaaatgtactcatatttagtgtcaacaaaaataaacatcttgttccaaaggtcttcaccattcactttaatgatttcaaattgatttgtggccaccatttccaattgcatcacctgtattttcctacacattcaaaataaaaaaaattaggaagaaatgtttagacaagtttcaccacaataatatcaacaaaatcacactcctcctcctcctccctacttaccggtaaatccaaggggatttagaagatttcaagggtgaatttagaagatttcaagaggaactttgatgagtgaaggttgtaagaaatagctcatttttggcaacagaaagtatcaagttggactatttcaacactcaagtgaaactttctaacgcttctcactttgttgttaccaacttctagcagataaaaaaagaccctgcctactagaattattttagagagttcatgtaataaattagctagtctaggaaacatctgtgctataactggcacctctgcttttttttttaatagctcctttaactctacaaatcatggacttgatcccaatggaacttccatgatagaacaatgtaatgctacttagtttatattaataaattatccttgttaaccaaaaaaaatggtaagaaatagattctaaacaaagacaatttacactacaaaatttttagagatgttaaaaattatctcttgctcaaactttagggaacctttgacatttgaatcaaatttggccaaaaactaaattttcacccctagtagattgaagaatgtgttactacttatgaaggaatcaaattgtttactcaataaaaattcatatggccaacccaatttctttaaatctaaggcgcatatttgtttgaaactggggctttgttattgtataccaatattcaccaataagtataacatgttcctttgtgctaattgtgggctgtagcactaggatagctataagaatagggggcagtctcatctggagaaacttagggctaaagggtgcaatcgaatgtccttgggattcagggagccaggcaggtaactcaagaaaagaaaaggaggaaaggtttgagaataaagaggagcagcagcaggtttatacactgctgttgtcacgatccaaatcctggtcgcgatggcgcccggccgcaaggctaggcaagcccgaccataacaacccaacaatggcattttagcccaacaggaagggttttccttacttaaatagccatttacatattagtccgcccattcgggaccaagacaaaatgaaaagacagctgaaacaaagacactttcccaaaaccaagggtcacgagtactgagcctctaccaagacagaatacaaatctggaagacgaaagatacaatgtctgaacatataataatacaccatccgaaatactggaagaatgtaacaaggatcggagaagaggtcctgcggacgctggcagctacctcaatactctgaataatccggaaccaacggcaacggcaaaactatgccccagcaacacctgaatttgcacacaaggtacagggagtatggggtgagtctaccaactcagtgagtaatgaaagtatgtaaatacccgaaagcagaaaatccaaataaagcacatagcaaggctaaacattgaccgttccgcttatctcaatatcaccaatttaaccatgcaaagcaacagataataacatatgaatatgatgcaatgcaatgcatgtccactgcggcgtgcagcccgagccatccgtattgggtacccgcgctcactatgggggttcagactccggaggggctcctacagcccaagcgctatatcatcagatatatatatcacagtgccaatagttaccactgtttccttttacaaatccacggtgtcaatagttaccaccgtttccataaatcatgcacagtccataaatagagtaaaatcaatgatcatcagcccaaattatcataaaagatatttaagttatcagaacatatcactgtggctgagttttaccaaaatagagtttcaaaacctttggactgcattcaaataaagtgcataatatgataatgcaacaaatatatccctgaaggattttacaagtcggcacaaggccccaatcatggcattaagcccatatcaatccctaaaggattattcaagtcggcacgtggccccaatcctggcattaagccatatatcattaatatagtatgcataacagatgctaatatatatagtcttatccctcgggttgagccgagtcacaattcatatctcttacaactccgcactatccatggagtgcgcgtctcatcatcactatagcatcgcaaggtgatttaccggggtttcgaaccctcaggtaatcacataaacccattactcacctccaaccggccggaaagctagtccgcaatgccttttcctttagaattctccttcccgagcgatgaatctgcccaaaatcacaaccaatatattacatgatgataatgggacataacccaattgaaagaactcgaaaaacgactcaaatctcgaaattcacaaaacccgagcccccggcccacgtctcgaaatccagaaatttttacatcacaatgaccctcgtctcaccccgagtctatacataccaatttcatcaaaatcggagtccatttgacccctcaaatcatcatttaaagtattgaaactcaaagccctaaatcatgaattttgtccaactttcagggatttctacgatgattctatgatataatcacgtaataaactcgtaaaacttacctccaattgatatacgttgaaatccccttcaatctctattcaagagctctcaaaattggttggaaatggtggaaaatgtgttgaagctcgcggacaaaatcacacttaaagcattctgtccagttacagtgatttcgcatttcccacaaaaacttcgcatttgcgaactccctttagaaagcccgaagttcgcatttcccataaaaagttcgcatttgcgaactccctttaaaaagaccaaagttcgcatttaccaagaaatgttcgcaattgcgaactcacctaaaaatgcccagggttcgcaattgtgaagcaattttcgcatttgcgaagtcgcatttaccatcaaaattttgcatttgcgaagtcacagcaccagcaattttcccgacactaaaatgagcatatcttcctcatacgatgtccaaattcgatgattctttttcctatggctcctaaatttcgatacggatctgatggttcaaacaaaactgaatttggagcccatttgcttattatggtacccttatatgtccaaaggaccaaacttgaaacatcgaataatagcgggatcacaacccgaaacacacccgaggcccccgggactccaaccaaaaacataaactcaacctaatacttcattcaaacttgctcggatcataaaaacgctatctttaacatcaaaaatcaccaaaatcctaagattcaattcaagctttaacttaaacttttaaatttcatattcgatgccgaaaccaaccaaacgaagtccgaatgaactgaaattttgcagacaagtccaaaatgacataacgaagctacagcaactttcggaattccattccgaccctcggatcaaaatctcacctaacaaccggattcttccaaaattccaacttcggcaaacttcgctaactttcacaccggacctccgaattcagttccgttttctctcctaagtcacaaatcatcccccgaaactagtcgagcggtcggaaatccattccgagccctctaactcctaagtcaacgttgggttgacttttccaacttaagcctttcttaaagagactatttgtctcatttctatctaatctccacccgaaccactccaaactcatcaaacacgaatatcaatacacgggtgagcatattacgggggtaacgggactgaaatgcaataattgacgggtcggatcattacatcctccccaacttaaacaaacgctcgtcctcgagcgtacccagagctgtactagaagcaatccaatagccaactgacaataccagatatatacccggagtgatcccacgtcaccctaactcatatagatttgatacacatcactgctgaaatttcacaactcagtatcagcctcaagggctcactaccagctaataacatatcagtaacggcctctcgggcccaatatcaacatcatggtcagtcattgttacctgaccggtcagccattgttacctgaccattttgtatcatacagtgtcattgttaccactgttttaagtatgtcatacagtgtcattgttaccactgtttcaggaatatcatacataagatcaacacctcatatctacactcagaattaatttgaaccagctggaacaacccatacctgcaaacctcaggtgaattcatgcaatacactacccatttcaacacttggaatggtagtctttattcatagcagttgctcataatactcaataccaataggtaaccccttattcagctagagccttattccaatactttcacgtatcaccaacgatgactaaaacacgcaatgaactgcagcaagtctttcaattcaaccattcaggaagtcacttccaaactacccattactacgacagattttcaggccaaaccttgacattatccttctaaccagctgaaaccattctgttcatattcattaatgacccccaatgatcacctcgatacaggcctaagccacaattgcataatacactcgccattacgaaacagtctaaacctacccaaatcaggtcaactgactcaatcagaaagagttatacatcaagctcttcaatacctttatgaaacaaagctgggactccgtctcgcatcataagaatagagtacttgaatcctcctcgcgaggtcataattccacgtggccttgccacaacacgcaatcttatcccaacactgttacccatgagacacctcatgttaccatgctcaaagttgacagccatgcacgaatcaatgcctaaaatcaagtaacccatcgcactcacggtgaaacaagtaatatacaccattcagtcctgaagggacacaactgatacgctattcgccagaaatttttcaaaacagactccactcggaaatcaggaaacaaggaatacaattcatcacatcgtggcggcgtgccacccgatccacacaaccacctcatatagggaggtgcatatcaaaccgaatttgctcatagtaacaaaataccaacatccgcctcaaaggcccaattaagaaacgcgactcttcccagctaaccgctaggctctggaacataaccatccagcaagaacatagtccgatacatcccgccacgcaaccagtggcatttccccatatgactcatcgcacaatcatttcgaagactccaacactgggaaaatcactctacattcccataacatatccagaatttaatatatcaagtcaggaatgatccagccagactccaatatcccaatagttgctgagagtaacaacaaatcacgtgattcataaccactacatatactgcaccggagaacttcaaatctccaactaaccatagtacacaatccctgcaacggatcccaattgccacaatacgaatacagattacactcaaatactcaattattccacgagagatattccaaaattcccatctgccatcaaacatctcaaatatccgcagtcgattccgtaaggaaacactgtaacactactgacgcatcattgtggtattaccctccttctgaaacatatgccatcgccaaatcactttcaatttacaataccaattccctggttacctaaggcttctcattacctacgacatagccaaatccaccttacctttcaaaattgagtcgaaaacttacacacgcccatctcggtcctttacaacataccgcatatatcatatcctccaaggataacacgagaacttttatctcccttatgcgccgcaacatcgacgcacttaactagtctagaacttgtattgatcccatttagaagaaaattattatgcacctcatgccatctcacatccgtagaaaatgcatcttttcaaccgtgtattaatcaacaagaactctcccaattccatttgcacacacaaaccgtcgtgactgaacccctttttaaattacgacacgctaggaaaatcatcaacacccaagagctttgctgcaaaaatttacaggtgctaacccactgcctcgaatgcacaacgagaactaatcacatccttaccatgccgaatccggtccactaacaagctacttgatttgcctagatccctacctgattccttatcaacttgatatactctcttgctgtagcaccacaatgcctcaacccaggcttactatacgaatctcaccaccagaacacactgtctaaggcccataggccactgaatattttctcaaacgctctcataaataccacatctccaaagtactttgcccaaagaatttcccgcgactctgaattagttacccttactttccaaatactgatgcctagaatttcgtaattaacatagaaatacaacaagtcttgacctgtgctaatgaaaacactgacttggtcacctactcaaccttaaaacacctaagtgacacatatagaatcttgaacacctcaaaaccatttccaaaagtcatccactcctatatacactgcaaaacactctactcaatgaatcaaacctctcatgccttatcagcattctgacaccacatgacgagatctcatttcgatacagccaaacaaattccttctctttacattaagcattcctttacccacaactcaataccttcccttattttctcacatctacgaagtaccatataacctttggcaatattttgcttcacttgtgctaacctcggttcactttctgcagccagaactgattcactcacttgcatcaaattaaaccaacacagtacataaccgtaccaccggctcatcaacatcgacctccccaacttagttcgaagccatatatattaaaatacacatactctatagcctatctcaataacatggcgagactaaactcactctttcataagcttgcgaaaaacacgcatcatcagaaattctaactttgcattacttcacaccaccgttaagcccgttctttaggcgacaaaattttcactaagtcccagattttctgaaaatttcgacagagtttcccttgtaactgggcctatccacctgtcagagaactaccaaaacatcctaacaactcgtccacaactgacaaaatatcacaatatacaataataacagaaatctcaaggctacacgggatatattaccaaaattgatacctgaacgtgcgttgcacttgcttaaatcataacatctagaaatatacccttaattacacataataagcacaccacttcataacaatctgcaggagatacccacctgcttgctttcacatatattttcggtacatcacttaccattaatacctcacgcaatcaattgacctttctgagtatggactcataccacaacatgcacactaccctgtaggagactcgaaaagattcttcacacgcccataactcggggaaacacatctgattacaatagaaatcaaacacttaatgattcgcttagcgtctagaaaaccctcctcgacattgccaagtcatacagactcaccacacggcaccgacgtacttatcgtgaagctatccagccgccgttaccacaactggggacaatactgaactttgagctcattgcgctagctcgctaaatcagcaccttggtgctcaagccatagacaaagattcggcctcaagtcctccagactggacccatatcaactcattgaaatcatcactcgcccctcgactggggaaatcatcagccatcaaggcacatatattactgagcgctcccgggcgcatacaaacgtgagaaaggaatttcaataatcacatcccaagctgaatcaagtacgcatgataagaattccaagaatgtgaagtgtttcctaaagttctgtagcctcccgtggatatgatacggacgtctacgtaccgatccacaagactctactaaactggctcataactcgtgaggcctagtaacctaggctctgataccaagttgtcacgacccaaataccggtcgcgatggcgcccggccgcaaggctaggcaagtccgagcataacaacccaacaatggcattttagcccaacaggaagggttttctttacttaaatagccatttacatattagtccgcccattcgggaccaagacaaaatgaaaagacagctgaaacaaagacactttcccaaaaccaagggtcacgagtactgagcctctaccaagacagaatacaaatctggaagacgaaagatacaatgtctgaacatataataatacaccatccgaaatactggaagaatgtaacaaggatcggagaagaggtcctgcgaacgctggcagctacctcaatactctgaataatctggaaccaacggcaacggcaaaactatgccccagcaacacctgaatctgcacacaaggtacagggagtatggggtgagtctaccaactcagtgagtaatgaaagtatgtaaatacccgaaagcagaaaatccaaataaagcacatagcaaggctaaacattgaccgttccgcttatctcaatatcaccaaattaaccatgcaaagcaacagataataacatatgaatatgatgcaatgcaatgcatgtccactgcggcgtgcagcccgagccatccgtattgggtacccgcgctcactgtgggggttcagactccggaggggctcctacagcccaagcgctatatcatcagatatatatatcacagtgccaatagttaccactgtttccttttataaatccacggtgtcaatagttaccaccgtttctataaatcatgcacagtctagaaatagagtaaaatcaatgataatcagcccaaattatcataaaagatatttaagttttcagaacatatcactgtggctgagttttaccaaaatagagtttcaaaacctttggactgcgttcaaataaagtgcatattatgataatgcaacaaatatatacctgaaggattttacaagtcggcacaaggccccaatcatggcattaagcccatatcaatccctaaaggattattcaagtcggcacgtggccccaatcctggcattaagccatatatcattaatatagtacgcataacagatgctaatatatatagtcttatccctcgggttgagccgagtcacaattcatatctcttacaactccgcactatccatggagtgcgcgtctcatcatcactatagcatcgcaaggtgatttaccggggtttcgaaccctcaggtaatcacatacacccattactcacctccaaccggccggaaagctagtccgcaatgccttttcctttagaattctccttcccgagcgatgaatcttcccaaaatcacaaccaatatattacatgatgataatgggacataacccaattgaaagaacttgaaaaacgactcaaatctcgaaattcacaaaacccgagccccaggcccacgtctcgaaatccagaaatttttgcatcacaatgaccctcgtctcaccccgagtctatacataccaatttcatcaaaatcggagtccatttgacccctcaaatcatcatttaaagtattgaaactcaaagccctaaatcatgaattttgtccaactttcagggatttatacgatgattctatgatataatcacgtaataaactcgtaaaacttacctccaattgatatacgttgaaatccccttcaatctctattcaagagctctcaaaattggttggaaatggtggaaaatgtgttgaagctcgcggacaaaatcacacttaaaacattctgtccagctacagtgatttcgcatttcccataaaaacttcgcatttgcgaactccctttagaaagcccggagttcgcatttcccataaaaagttcgcatttgcgaactccctttaaaaagaccaaagttcgcatttaccaagaaatgttcgcaattgcgaactcacctaaaaatgcccagggttcgcaattgtgaagaaagtttcgcatttgcgaagtcgcatttaccatcaaaattttgcatttgcgaagtcacagcaccagcaattttcccgacactaaaatgagcatatcttcctcatacgatgtccaaattcgatgattctttttcctatggctcctaaatttcgatacggatctgatggtttaaacaaaactgaatttggagcccatttgcttattatggtacccttatatgtccaaaggaccaaacttgaaacatcgaataatagcgggatcacaacccgaaacacacccgaggcccccgggactccaaccaaaaacataaactcaacctaatacttcattcaaacttgctcggatcataaaaacgctatctttaatatcaaaaatcaccaaaatcctaagattcaattcaagctttaacttaaacttttaaatttcatattcgatgccgaaaccaaccaaacgaagtccgaatgaactgaaattttgcagacaagtccaaaatgacataacgaagctacagcaactttcggaattccattccgaccctcggatcaaaatctcacctaacaaccggattcttccaaaattccaacttcggcaaacttcgctaactttcacaccggacctccgaattcagttccgttttctctcctaagtcacaaatcatcccccgaaactagtcgagcggtcggaaatccattccgagccctctaactcctaagtcaacgttgggttgacttttccaacttaagcctttcttaaagagactatttgtctcatttctatctaatctccacccgaaccactccaaactcatcaaacacgaatatcaatacacgggaaagtatattacgggggtaacgggactgaaatgcaataattgacgggtcgggtcattacatctgtattggttgggagcctgtagaaggcctcttctagctgcagctgtaacaaaggaggatgaggagcttatgaaggactgcattgatcatcagactcaaatcaaatttgaggagagtctgctgaatttttttactaacgttgtttgcttttttgcaggtccagcctctaggcactactcctcgttggatttcttactggtggtattagtgtactgcactcagcccagtagaatgaagatgggaataggtcacagcgtagaggggtcaaggattaaacaacagaaccacaaaaaatgcacagaggaaaagcagctgaattcagaccatttggtcacttcatttcaacctttgtggacagttgaatcaatcaactggatgatacaaatgtttacaaatgctaggctacatatggatagaaacaacacaggagatacagggagtcaggaaagagatatggaaaaccacggcagcaatcaggaaggccaaaaaatagatcataacagtcgaatccaaatggaggggacaaaactgatctatgacagcatggtctacagtatgatctgtggtgcacattgtaaaactactatgattatggctaacttcatgggaagcttgcagctggtggtattagtacttggtactcagcccagtacaagtgactcatggatggacatagttacagtagttatgcagaaaaaggacaatcacacaccaagtcactttggtcacagcattggtttgggttgcataactggaatatggttcatgagccatatacatgttaactccatctagatacaaaacaacagggaaaggtcgacaggcaacagtataggattcaacgaaatggaacacaaaaaggcgtacaggaaagttaaatggaacaatcaattcgcaggcaagtgttggcttcatgatgcgggtaaagttacactacatggtaacaacactacagcagtacagcacaaaggaactcatcaagaccacagcaagggaaggaaattagcaaacaatgcgatgaagaagaaggcatctgggcagctggacacaaatagttgcagtttctggaattgggcgcaatggataagttggatcaaagcgtgattattgtgacataaggctacacttataaagcgtgattattgtcacgttataggctacgcttataaagcgtgattatttgtttgaaactggggctttgttattgtataccaatattcaccaataagtataacatgttcctttgtgctacctagatatatcaatgcataactgtaaagttttgaactcttttacatttccccaatgagcgtttcatttaggactgcagatgagttttcttttttaagaaataagttactagtatgaagtacttcaaacaaattacttcgtgtgttctgcgactgaataaagaaaacactttgtagtataaaataagtgctgcctaagttgttcggtatcctcgattcattaaatactctaaacgaacatttcactaaaagaatacacaagacaatgaaggggagaagaagatcacatgcgcatgatagaaacacaactacaacaagcacaggcaacacagatgtgagcaactgggcagtagttcgagcaatcacgcacaactggatggggcaggatacaaaagggaacaaatacaatacatatgagtacaaaagaactgaggaactaggatatacagccgaggacaaatacaaggtgacgggccaacatggcaagcaaacatgcaacaatgcagaaattggctataacttctatagtctactttcaaacattaacccctagaatcttagtcatgacaatagattcagtttcctatcacacacttatagaaagcatgattttgtaagttacgtaagattgaggtagtttttggaattgtaaaatataaatacctttagaaaattcggggcatgagttgagccagaagaatgttgtagatttttgcctctcatagctcgtgcactacttgcatcaaccggtgaaggaatattagatccaacacacccttgtatatcatgaaaatctattccagggttgttttttcaccatttgactaaaaagacatcgcatttcttccctcatcatttccttcatttcttctttcagagaagttatttcgttggcatgcttttgtttaagcttggtgatttattcatcttttcttagagagcttgtcgtcaccgatctaccatagcatctaacccgaccaggttgctcctttccaaatacagccgtaaatgcatcatctgctgtttctccagaactttggcgattttgaagttcagactgtcaaaaaaatatgattacacatcacttactgtcaaaacctgtcacctgcttgcgttttttatatttaaccaagttacaacgaccagacaaagaagaagcagttttcatcattacacaactctgttcaactattccatttttggctttgctaacagttaaaatattttccaaccataattaagcccaaaagttaacaccttcaacacacatcaatcaatcaactaagccttaatctcagactagttgaccaaacacatgagaacacatcaaacaataatatgttgtatttcagattccagtacaaagcattttcaagatattaaaatgacagttcacagtggcaaacaacagtatgattaaaatacaaaagggtcaaattaggtgaatttaagttatattcaacaacaactctaaaacaaatacatcattgacttaatattaattagtttcagtacttctgtccaactatgtgactacctattaaatgaagtagagaaaatagtgcattttagtcaacgagaagtgtagaaccaattcaacagaacattatgggatttcagaagtcaaaatcatagagaactatcttacaagcatagacaaggataacttactattgcaacttgagtatccgtatgaacttccttccctttctttgtacgagttgtaataaacatttcagactgtgatggttcctcgttgttctctttggttgtgcgctacaaattacatcaaagaagatataaaagacatcactgtgttccgacaaagtacaaaaagacctaattatgtcaggttacaaagtgtcgactaaatattaccaatgccacacgcactcttgcaaaattaataggtcccattcgatacctccacttttgttttttcctattttcagaatttaattggctcatagcctaataacaaaagacgcatattaatttataaatcaaaaaggaaataatatatattgcaacaataggtaaaaaatgtagaaatgcacaggttaatcttacttggacatcttcatcattccaatactcaatcaattgacggaattgaacttcaggtatctcattgggacgattttgtagcatttcgtcaatagtagcatttttatcaaaatatttctacttaatatttctcttgtgtcgcttccaagcatcacgaagaccagtcattacccacttctctccttcagctggaattaagaacttggactgtgcaaaacaacatatatatatatatatatatatatatatatatatatatatatatatatatatatatatatatcttagtagggaaaatacaaaaaatatataattaaaaatttaattattcttacattgacatattcccacattcgttgcttaatgtcctttgacacaacatgccaactagtatgcaccaaggggataaatctaggattccttgcaattgttcccaaaaagttggtcaaatcagacactctcttgtcagttggtccaactgcttgtcctttatcaaatgtcacctcctctctttcttcaaaacgtcttgcatgaatagtcttacatgttgtttgccctcgaactcttttcttctctgatgaccctagagtgatataacaataatgacataagcaaatgttcaatagttgaattaaaaaactaaagagtagcatcaattaaagcacaaaatgagaaaggcaataagaactaagaataaaaaatatataaatgggcagaaacggggcagaatttttctgaaaaaaattcgccagcatttccacgctttttggacgtttataaagagaaagaaaaagaaaaagaagaagaagaagaagaagacgacgacataccagctgcagcaccatcgatgttcatctcctcatctccaataaattcatcgacaccaacttcatcttgtgcagcaaaattatccaattctatttcacgttcatcaataataggagaggacataaatctgacttcgttttctgggtgattatcaggatgtttttcaccaccgacttgtatcccatatttttttagaaattgattaacactcgtcgacggtaagactgagtttgtctttacctttttgcaatttggtagctcctgaatatcatgatgtttctctccttcaccttgtgatcttttaagcatatgtgaaatgttaggatctacctttgcagacgattggatcatggatgtgggcacaggtaatttactcattccttgcttttgaatgggctcctccaattgaattgacctttgtttgatttgtcctttacttgcaatactattccttcctaacttttgaaccgacacatcggattgagttaacttctgtctactttgtccttctaatgttgcaggcatacaattcttccttttaactccaagtaatgtatgctctttagcagctttatcattgcgatcacttgcaagattttctctcttaatctgaaattttttggctagttcagcacttgatcggtattggaaatcgaaacctatattcttcattggactttgagctttgtttggattcggaacttttctcttaagagctgccgcttgattcatcctacatacaaaaaaaattaaattactttagcctttaactctcaaattacaatcacaaaaattctttcttgaacccaaatatccgtacaaaatattgttgaaccatgagagaaacagactaccatgtaacaccaaatcacaggcaagccacataaaactctcaaatagaacttttgtttcatgtgcatttcccacatttggttttaattatatatctgcatttaacaagtgatatgcaactaacagttctaatatcatacatctctaccaaacaaactctaatatcatgcatctctacctaattacacgttacaggtgaatttcagttgtagatctacatttacaacttcaacgaactgacagaaaggaccctccactttccgggtaaaagaatcagagttgacataagatcagcatcagttagtatatacaaaattgacgaaactgctgaacttttgacaaaggttcaaatcactaagtctgttaatatcgcaaacatcaacataaaatggaacaatgatacctgttcaatatctcttggttccttaaaattggttagtccaatatcttctatgtgcaccacctgataataataaaaaaacaaatacgtatatacgttaagacttgctccaatactccaaggaatacgacaatacaaattccgaagcacaatttccacttactcacgttcacttctctattcaaaactagaggacaaattctcgatccacacataatacaatacattgaataaccaatcaagtaatttctagtgataccaaaagagacattaaaaatacatgagcaataaaatatatgtgcacatcaaagaaatcaataagcaaaaaaatattcaatattgaacttgaggaaatagacaacaacaatttaaaactaaagcaacagtctttaatgtgtttctagctattaataaaaaaatggctaagctattttctatttgaattagaaagaaaaaaaaactcatgatatgtcttcaaaatcaaactcttcatccgattcaatttcaagttgttgtgctagaaatccttctggaggtacatcaagaatggttgctggaacatcactccttactaaggcaacttcaccattatcctctggtatcgatgggccagccaaatattcagatggctcattttcataacattgtggggcattagcttcaagttcatcacttatgctaaacaagtctctcgggacagtcttcatgacataatatccatcttgatcatatggatcttgcacatagaagcattggtgtacttgagatgctaggacaaaaggctcattctgataacatttcttgttgaagtagacataagtaaggccataaatatcttctccaacctcataccagtcacacttaaataagacaaccctaaaatgtccataatagtctaactcaactatatcaactattctaccataataagtcaaatttgcgtcaactggatttttatcttttgagcttgcaaaacttgtagtttgagagactaatgtaacaccactgttttgtgttttacgtcttgcatcacgctgcctcacatggaatctatatccattaatgagatacccagaatatcttttagcaactaaatttggtccgaaggataattgctttataagatcgggcacatcctctttcaaagaacgagtttcaaaccattgagagaagttttgactatacttctttgccttgctccattttgatcctcgtctctgattactaacctcaacctcatattctctacacaacaagtatttttatttgttagtaaaatgataaataaagtaatttaataacaatccacacaaataaatgctataagtgattaaattaccttatatattcttgaacttcatcacaattgttcaataagtatatatgtgcctgatttagtgacatgtcatctaacacaattggatcactcttttctgctcctaaaggacaacctgtattagggaacaaactagaagattgtgcattaattgaatcatattcatcattgtttcggggtcgtcgattaaatcgagtctttacatcttcatgtaagtacctagagcataaagtcaagcactcttcaaccaaatatgcctcagcaatagatccttctggataatttctattgcgaacatatgattttaatgtacacatatacctttcaggaggatacatccatcgattttgaactggacctcccaaccttacctcatttgccaaatgaataggtaaatgaatcattatatcaaaaaaagttggaggaaaaattctttcaattgattcgttgtttctctaatctctccttccaagtaatctagctcttccattgtgataactttttgacataaacgacgaaagaaagaacttagacgaatcaaagggatagcaacatgatcaggaagtatgcttttaactggtattggcaacaaataatgtaacatgaagtgggcatcatgggttttataaccggataaatttctttcatctaactgcacacacctggatatgttggaagcactaccatcaggtagctttgctgtctttaaaacaccacagaaaactgatttctcaccattggtcattgagaagcatgcttttgcaaactttgttctcttgccatcctttgtatcatttggttgaaggttcttcctaatgcccatctctttcagatcataacgagcatttggatgatcctttgtcttgccagaaatgtctaaaagagtttctattacattatccactatatttttctctatatgtattacgtcaaggttatgatgtaacgaattgtgctgccaataaggtaattcaaaaaaaaattgacctttttttccaaggaccatcatttgttctctttctcttcttcccaaacacattgttaaaattctgtaagctattaagcacatcagttccctttaacaaaggcggaggaggcctaaattctatttttccattgaaagaccttttattagatctccaaggatgatccacaggcagaaaaacacgatgatccatataacacatttttcgactatgtttaagataacgagaattagtgccataattacaacaagggcaagccaactttccctttgtactccaaccggataacatagcatatgcaggaaagtcactgattgtccataaaagagctgctcgcatttgaaaggtttgatctcttgaagcatcatatgtttctaccccggactcccacaaaatatttaactcttctattaatggttgtaaataaacgtcaatgtcatttccaggtgatcgtggcccgggtataagcaaagaaagcatacagtactctggcttcatgcacatccaaggaggtaaattatacaccattaaaataactggccatgtgctatgagatatgctcatggtccgaaatggattgaacccatcacttgctaagccaagtcgcaaattgcgagaatcccttgtaaattctgtatgcaagctatcaaagtctttccatgcttgcccatcagcaggatgccttaactttccatctttagaacgctcctcgtcatgccacctcaatgtatttgctgtctttgagcacataaatagcctttaagtctaggaattaatggaaagtgtctcaaaaattttgctggaacacgatgaccttttttggaatcctcaagatcgttatctacttcatcgctatctacttcaggatatttaatatatcgatatgatccacaaacatgacattattcatcatctttatggtcattcctaaatagcatgcaatcattggaacatgcatcaattttttcataatcaagaccgagatcttttaccatagatttggctttattgtaggatataggaatgttcaagtcaggcatcgcctcttttaatagctctaaaatagaagtgaaagacgcattgctccatccatgtagacacttcaacaaatacagacggattgtaaaagataatctagagaatcctttacaaccaggatatagttcttggcttgcctcgtcaactaagttatagaatttattggcatcttcatttgggccttcatacactcctccagcatgtgcaacatttctaaattgatcattcaacaacccatcaatatcatcgtacgagtaaacattatcatccatgtcacaattagaattcatcgaaatttcccattccccatgattaatccatcttgtataaccttgaacaaacccataacatattagatggtcatacactacattccttcgagtccaacaaatattacaacactttgcacatgggcattgaatttcttcgccttgaggatctccataagagtaagcaaaatctaagaaagattgaacaccctcgatatactctttactataccttggtaaatccatccattccttggatggaacatttgaattcctaaaaataaaatttattagatcttgaaatatataatcatttaagcattaattatatgataaaactaaatcttaaatgtcaagaataaatctataaaatcatgtgttgtaaaataataggactttcttacctagtcatgactttaagctaagccaaatacaactttaagtccaccgcaaatcttcccgagcgtgacttatcttcttggataaaaaacagtaaaattaggatccacaaaacaaagacagaaagcaataaaattctaaacaaagtattaactttacaaggtgaaatcgaggcagcaacaacagctggaccaaaagttaatagtcctgctgatgcacaatgcttcaacaatgatgttaatattgctcatgtatctcatgcattagctaggatgtctaaacgtatggttattagcaggaaatagggtgtagaataaagaaggtcatggcagtgttattatgacaacaacacaaggtgatcgacctagtattgctacaactgaacaacctgatgcatagtttatgatgtcgatactgtgactggtgagggacatgaacctgtaagtgttgaggattaaatgtgcaaaaatagaagtgagctaacactagttaacaaggcattataatccatgaaagaatatccttcatcctcctcctacaaagttaacaaggcattataatccatcttctaatattgtgtccacatttggccctaagacaattatttgccttaagtttagctacccagtgacgtacatgaaatccagattaagtcaagaatcaaactaacaccccatgatctttaacctatcaggttaaaaatgagttgttttcatcaaagaaaggccttactgaaagttcttattaattattctttaaacagggtcccacccaagatttctccaaaagcatgatgacagaatgactttataccaaggtcatcacagtaacaacctcaagagtgagttaccagttagagatcatgcaactacctgtgttacgaataaaagcattcaagtagctgctttaggacaactttactgtagctgtggggctcattattccaggaattcacaattatatgattagaaggaggatggaactattgagagtttaagtgagaaagcattagagttctccgacacaatagggtcaactgctttttttatggtaccacctattaagagttggtttgcccaactcattgtatcaagaaccattttcaaatgatttcacattgttcacaaatatttatctttcaccaaaaaaggcatttaacggaaactagaaatcaaattttttctacaagtagataataagacacctgcacaggtgaccatcgcttagctggatcaaactccacaagataatctgaattcctatcttgtggttttcagttagctagcacaaatttattttcagttggaaagagatctatgttctagccaatgacaacaattatgttaacaaaaaagatccatttgacgtgttagatgtcaatgcttgattacctaagtattgccaccaaccttcttgtgatctaaattgtgcattatattcagaaagacctatcgaggaaaatattgatcatgtacagaagatgtcaattggtgataacttattacttcttgttcctctcttaatattcaagagtacaaatgacggaaggtagagtcagttgactatttcttctgaacgatcaaaaagaagtcattggatttgactttgcaggagagacttggggaagttccaggggaagatgatccaagaactagtcgagatgaccaacttctgggcaaaaaagcccagcattcttcacaaaaggagtccgagcagggtagctaatgacattctggctgcagtaatgtggattaatgattaggagcttaacctaacaaactttgtaatagaaagggtttaatctgcagattgagtagtagtttatcaggatctgtatgtccaacattgtccattgtttctctgttggaccaatcttttaaggtcgagaaacctggataatatatagagaatgtgatcatcgcagtagttctgttcagtctaggttcgaacccgtgacatgtgcaaaacacacacatcacgcgccacgctcttacccctagaccaaagcccttggggcgattctaattgcagtcctgatgcctcactaattagatatgctatattatcttaaagtggataaatataaagtgaaaacacttctgagatggacttgaatgtagtaaactattctgcacatttaagttaatagaccagttttattaaacatttttctcctgctgtagttccagtgtcccaggagtggtaacacttagaaggaaagcagctcgcaagcacagaagtcttgtgctcctaactctgctttctgaaaccatatccacaactctctattgaacaattagcatactagggaatgactaagtttcaggggagattctttaaagaggagaaaaggtttgcggatcactaaaatagaaaatttggtcattgcactgataatagaagaaaacttctattgaagccataagacgaaggactacgaagaagtgtcaaaatcgccccgtaataatctccatacacaattctaacattcgggaattcgcattgtagagatgttatacctctgtttaggtatctattatggtacgaagcaaaattgttataatttctcaagcaacccaattggtcgtaaccattcgcattagaatcaggaaaagatgtaagatacaatggaagacacccgagaggataaattcctggaaccaaaatacgagttgccccaagattaattctgggcaacaacttctatcaacagacaaacgtgtagagaaaagtatggatgcattaactcaagcacaatctacaaataagatgatgtctaatgagcaacaaattgtgacaaacgacctcaaacatgggatgctcaatgtaaacacgataaagaggaggaatttgagaacaacctggaagaacagcaccaacctgagattggaagaattcccgcttctttagctttataaatttcttcaatctggaacgaggagggtgagaaggtgaaaaacagtacctaagagaaaggggaaacggagatgatactttgagatcggatttcttcaatttgaaaaatagggtttcttcctttgagatgatactttgaaaacaaaaacaccacccaaagtgagaaggtgcagaaattaaggaaagaaattagtacagtacctaattatgctgaagattcagaatccacaatattgaagccagaaaccctagctaatgtatccacagatgttagcgatggagagaaatcctttagtccttttgaaattgaagaaataatattttacacagaggatatcggatacatagagtatatcggagggaacattatatttttggagggaatattatattttggccaaatattttgttggacttttagagcacaggtataaagtgtggcttttccaattataattagagcacgcttaaaaagagtgtcaaatactcaattaaatgttgccaattgttttataattttgcaacgtttaataagtgcggcctaatatattaaagagcacattttacaagcgtagcaatatttttcgtagccaaaagctccattcagaggccaccccttaaaagcgtgcccaaatatatttttgggaacacttttcaagcgttgtctaaaactagtgtggcgttagaccataaatgttgtagtgatgctagcagttctagtaggtccaaataagtccatatgaagtaattgcaatggttttgaagtggaaactgtgtctttgtttttgaaagagtttctattttgcttacccatctgacatgcatcacaaatgtgagtcctagaaaaattcaatttaggtaacccaatgactaaatcatgtttggataatttctcaatcagatgcatgctagcatgacctagtcttctgttccataaccagggatcatcagacatagaggttaggcagatatgaccatctatattttcgaaaccatcaagtatataaacatttacgtacctttttccagaaagaattattttatctgattcgtcttcgatggcacatccagttctcttaaattttacctcatatcatgaatcacagagttggcttatgctgaggagattgtagtttaatccatcaaccagatatacttcagtaatatcatagttgttgttaaaaggaatagttccagtgccaactattttgcatcttgaatcatttccaaatttgaagcttcctccatcaatgtttgtaacttccttaaatgggtttttgtctcctgtcatgtggctggaacacacactatctagataccattttcctttgtgtttactctgtggtgttcctgcaatatagaattattactttcttttaggtacccaagcttgcttgggtcctggtgagttagtgttactggactcagaattcttaggtttccaaacccatccggacatatgagatttacgaaagtgacaaccagaatatttatgcccacttctattgcaataatggcatttaaccccagacctgttttcagatctttcataagagttggaattagcaatcataggatttgcttattcctttccagttgacttgtaagtcgactggttcaaccgactggtcgatctagttatgattggttcttttccactcgacttgtaagtcgtctggtttgacctaacatagctatgactagtggatttgcgcaagctgttaaactgcatttataattcctcaaactcttcttgaaatacgtctttttaaatttcacatacttcatgtttgagtttccagtctttgacttccctggcgagtctcttaagttcactcatcatcttttgagactcttttagggtggaatcaagaatgcctttcaattcattgcatctttcacagccataggatcttacctcgctagtttctccttttgccataaaacaattttcattgtctgaatcatcttcatctgtccagcatcctgaagttttattgatctcattttctagaatcgtcatgaagtagagatttgctatctcttcattgtctgagtcatcctcatcactccagcttccagatgacctgttcttgttgaatcctctggagatctttctcttgagttctgggcactccgcttggatgtgcccaaactttccacattcgtagcattttccatccttcttgtcttgttcattgtattgtctagatcttcttggtagaaatattcctttctttgtatttatatatcttcttattaatccatccatgtttctggacatcatagcgatttcttcttgtagaacttcaggatcatcaatttcattctcagttgcttcaatagtagctttgaatgcaatagttttcttcttctcctcttgatttgtcttcttcagatgtgttcttttgaaagcaatgagctctcctcatagttcatcatatgataatttgttaagattttgagattccaaagtgacaactttagtctgccaggtggttggtagacttctgagaattttcctaacttgatcgctactagtgtatggtttgccaaaagcttttaagtcactgattattttactgaatcgggcaaaaatttctttgatggattctccttccttcattgagaatagttcatagtcatgaactagcatatttatgtgggtttcctttaccttgctggtaccttcataggtaacttcgagtttgtcccacatttctttggccatgtcacaactagaaatcttcatatccttcaccacttattgcattgtgaagcagattctttgccttgtggtttatttttacagcttccaattgctcctttgagtatgagtttatatcatcagggtcagtgagcggtggagtgctggcaggtaatgggtagtttcccttcttgataactctccatactttgacgtcgtatgctttggtgaagatttctatacggattttccaatgggagaagtgttgtccattgaagtaaggtggtcttacttgagaagttccttcttgaaatagagctccaacgataacctgatttgccatgatttttttctcacaagctgttcaaaaaaccaaaagtgtgagccttgctctaataccaattgaaagtacaagatggggggtgaattgtagataattaaaattaatcgtaaataagttgacttaaaactttagtagtcgactgaatatggaaatcttatagatagaaatttgaagtaatgtgcagaaagtaaatgcagaaattaaagacaccgggaatttttatactagttcgaattcaatgtgaatccaaatccagtccccttgggttgcaagggatttctcttcaagttaattagttgtcttctgagtacagatttgatatttgtcactcagtcttctagcactcgtttgatacaatgcctcaccacttgtatgctctctttatatccctgacttgttacacaacagatctatataggctactatccttgtttgcagtaaattgaagagagttattttggttcgatcaaagtatacgaaggatggggttgcactatgaatttatacaaggatgaatggtgaagtattgtcaacccaagggttttgatccctagaaagagttgattctttccaagaataaagcactaactgttgcttctcttaagatcttttcctttggcaaatgacgggtttgacagaattcttctttaattattggaccttccgatcttaaccgctgtccggatcttctagctttaattggtcttcaatgatttgatctgactcgtcaatcatagattgcgttgaatctttattccattacggcagatttgatttcctagaatcatggagttaatcctaattagctgatgtagtattgtttctttccttatgcatcgtgagtatttaaggcatcttcctttgagaataatttccttccttgttccacatagcaattcaaatagttcctttttgcttctttgaactcctgcacatacatattaataattgcatcattaaaatatgtataacatcggggacctttatattcagcaagatgtcgaacttccggaagggtacaaacctcccaagttcaaaatgtgggctcctagagtccatttgaggacatattggaataagcttgtcggagtcggaagggatgagaaaatccgcataaaactcttcatgagaagtctgaaaggggatgcattatcttggaacatcagccaggatcccaagatagtggacaacctgggtaggtatggcgtccgattttatgggcaggttcagatttaatacagaaaatgcaccaaacatattctacatccataacttgaaaaagaagcatacagaaatattccacgagtatgctactcattggagattagaggctgctaaggtcaggccggccttagaagaggaatagatgaacaggttcttcgtccgggctcaagacccacagtattatgagaggttaatgctgattgaaggccagaaattctctgatatcatcaagctaggagaaataattgaataaggcatcaaaaccggtatggtcaccaaccttgaagcattacaggctaccaacaaggctttacagtctggtggcacgtcgaagaagaaggatgtgaattccgtgatggttgcaaagaggacaaaatccccgatgaaatacaaaacatacccattatctcctctcacatattagcctacccaaaattaccaagaaccctcacccccataaaaacttccaccacccacttaccaatcatctccacctcccacatatcaacccacttcacccagatactctcagcctgcacccctcattatcaatcacctcccacttgccaaaatttccttagacctagaccaaacttcgaccgcagacctcccagataatacacagccatcgccgaaccaattgaccagctgtatgaaaggcttaaagcagccggttatgtcatcccaatccctgccataacactagaaaatccttcctagtggatcaacccaagcaaaacctgtgcataccactccggcatgaaggggcataccatcgacgagtgccactcgttgaaagataacatccaagccttaattgatagtaaggtcatcatagcaaaagatcccgctcctaatgttcgcaagaaccctctgcctgaccacaagggtggaggcgttcacatgatccaaatagaggatgattgggaccctaaagagtcaattggattgattgctgaaggggacgagccaaagaaaccaatagtcacactcaacccgattattgtccagatttaaccctccgagggtgatgaggtgaacatgtccataccgcttgatttcgaagtgcctccttcaaaggcatcaggaccaattgaagtcgagtttggagttccaaaggcacctgtgcaatttgaagttgttgtattacctccaagggtgcctatcccgataacaatgtcagacataacaccatttcactcaaatgccataccataggattacacagctgaagccaggaggaaagggaaaatcaaaactggagaagcaaatgctgcacagggtatgaccagaacaggcagagtgtacactccggaacacttagctgagtccagtaagcaagcctctggacgacttattaaaattggacccgatgatatgttgaggaaaatacaagctaaggagtactcgatcgttgaacagttgaataaaacaccagcgcagatctccatcctagctcttctgcaaagctccaacgcacacaaaaatgccttgatgaagatactaagcgaagcttatgtgcccaacaacataactggaggcgaaatgtcgaatatggtgggacaagtgttggaaagtcataagattatcttccacgaagatgaactgccatcggaagggctaaacgacaataaagcattgcacatcaccgtgcaatgaaaagattatttcatcactagagtcctgatcattggaggatccagcttcaacatctgtccattgataactctcaggacattggggaagaacctacacgagatcaaagactgggccatcaatgtcaaagccttcgataggtcccaaaggtccactattggaaaaatcagtctattcttgcaaatgggaccaacctggttagaaatcgactttcaagtgatagacgtcccagcatcttacaatttattattagggcggccctggattcatgttgtcggagctgtagcatcaaccctacaccaggtagtaaagttcgaatggaatcaccaagaggtgattattcatggcgatggtaacaaccccatatatagtcgccagaccatcccgatgattgggggaagaaggaggatataaagagaaacctactactatattgaaagagtaaatgtcgtggacaaggaaaaatggtgggataacaagattgagagtatcctgaactggtgtggatgcaaacatgggaaagggcttgggaagaacctccaaggaattgccaaacccatcaagctgaagaaacatggtaccacttttggtttggggtatgaatacactttggaggaattcaaccattggtcgccaccatggcgcggtccctacgatccactagagcatccgatacctcatctggagcaaactttctaaccgtccgacattatatatgggccagaagaagaagaggcattagtggcaatgacgaacctgtttctggaagaagacattatggattgttatgttattttcgaggaggaagggtctgtgttgactaccgggatctcaactgggcaagtcccaaagatgacttccccttgccaaatatacacattcttattgacaactgcgctaagcatgagctgcagtcgtttgttgattgtttcgctgggtatcatcagatatgtattgatgaggaagacgcagagaaaatgactttcaatacaccatgggggatatattgctataagacgattccatttggtttaaaaaatactggtgccacctacatgagggctatgactactatttttcatgacatgatacataagtagatcgaggtatatgtagacgacgtcatcatcaaatccaataaagccactaatcatatggaagacttgaggaagttcttcaacagactaagaagatacaatctgaaattgaatcccgccaagtgatttggggttcctgtctgaaaattactgggttccatcgtaagtcgtcgagggatagaattggatccgtcaaaggttaaggccattcaagagttgccgccgccaaataacaagaaggacgtgatgagtttcctggggagactcaactatattagccggtccatagctcattccattgtcatttgtgaacctatctttaaaatgttgaataagggcgccgccaccaaatggactgacgattgtcagaaagcttttgacagacttaaggagtacttgtcaacgccgccagtcttggttccacccgaaccaggaagacctctattgttgtacctcgcagtactagacggagcatttggttgtattttgggacaacatgatgaaacagggagagatgagcaagccatttactacctcaacaagaagttcaccccgtacgaggcccgatattctctactagagcgcacttattttgctctgacttggatagctcagaagttgaggcattatttctgtgcctacactacttacctcatatcaagaatggacccgctaaattatatctttcagaaacccatgcctactggaaagctagctaactagcaaatcctgctaagtgaatttgacattgtttacgtgactcaaaaggaaatcaaaggacaagccttggcagatcatctcatggagaatcccgtggatggaggatacgagcctctaaagatgtattttctcgatgaagaggtgtccttcataggagaagatatttcagaatcctatgatggttggagaatgtttttcgacggagcatcaaatttcaaaagagttggcatatgagcagccctagtatcataaaccgtctagcattacccggtatccgccaagctcaggttcccatgcaccatcaacatagctgagtacgaagcctgcattttagggctcaaactagccattgatatgaatgttcaggagttactagtgatcggggattcaaatctgctcatacatcatgtccgataagaatgggcgaccaagaaccctaagatactcccctatctacatcacatacaggagttgaggaagagattcacaaacaaagttcaagtatgtccccagggtccagaatgcatttgccgacgcattggctactctatcgtccatgatccaacatccaaataagaatttcattgatcccatcccagtaaagattcatgatcagccagcttattgtgctcatgtcgaggaagaacaagatgggaaaccatggttccattacaagagagtacttgacaacatgataatacctagagcttgccaacgctactcagaagcacacccttcggaggttgtctaacaatttctttcacagtggaggaattctgtacaggaagactcccgattaagggttattaaggtgtgtcaaagcaaaataagcattcagactattggacgaagtgcatgtagggacctgcgggccatgaatggttttgtcttagcaaagaagatactccgagaagggtattttttgatgactatggaaacagactatatccagtatgttcggaaatgctatcgctttcaaatatatgcagatatgataaaggtgcctccaaacgagattactgcaacaaacttaccatggccatttgccgcttggggaatggatgttatcggacctatcgagcctactacatcaaacgcgcataggtttattatagtggcaattgattattttaccaaatgggttgaagcaacatcatataaggtcgtaactaagaaagttgtggcatatttcgtccgcgactgtattatttgtgagtttggaattttgaaatcgattattattgataatggttccaatctcaacagcgacctgataaaagcaatgtgtgaaacattcaagatcaaacacaacaattctaaagacctcggatgaatggagttgtagaagcagccaacaagaatatcaagaagatactaaggaagatgattgaaaggcacaaagaatggcatgagaagttatcatgctccttgttgggataccgcaccacagtccacacatcaatcggggttactcccaacatgctagtttatggtacagaggctttcattcctgccgaggtagaaattccctccctaaggatcatataagaagtagagttagatgatgcagaatgagtaataggtcgctacgagcagttggctcttatagatggaaagagaatgaatgctatttgtcatgggcaattgtatcataacagaatgtcctgagctttcaacaaaagggtcaagccgaggaagtttacaccggggcaactagtgttgaagaaaatattcccacatcaagatgaggccaaggggaaattctctcctaattggcagggtccgtacatggttcactgggttctaaccggaggggcccttattcttgcagagatggatggagaagtttagccaaagccaatcaattcagacgcagtgaaacgatactatgtgtaactttgatgctttttgtttatgatgtaatttgaactacgcctgacctgattcccgtttaagaggggatacgtagtcagccctatgggtttggtcataatttaataaaaatttcatttcccccctgctattagaaactggggaagaattttgaggaggaccctcaaaattccgaagttgattttcagccattcatcgtacgcagccaccagaagtgccagcccagtaaactagggcagaattttgaggaggaccctcaaaattccaaagttgatttaagccattcatcacactgggccatcggaagcaccagcccagtaaactggggcagaattttgaggaggaccctcaaaattctggagcaaaaaagattgcaatgtcttgaaccacgtcgcagtcgttggttcatcttaagaaaactatttttgcttatataccaatgttatatttactaaatcatgcataaatattatccaaattgctgttgtttagtgacgctaccccaatgatacacaatgtcaggagccacgggaagacgaactaaccatccccctttacaaaactcacaatttttctttggatgcaggcactcgattcgcaatatcattaagtatgtttatgaacctacactcttccaaggacgcaacttctcagaatcatcacgtattcgcaattgccattcgtacacgacatccccagcagccacaatatcgcaattagctaccaactaagagatttcattactattccccattatatttctgcatttcatatggctagttttttgcctttcgagactaagcactgtctccatctgtattttctgtataaggctacttttctgccttccgagactaagcattgtctccatctgcatttctgcattgcataaggctacttttctaccttctgaaactaagcactgtctccatctgcattttctgcataaggctacttttgtgccttccgagactaagcactgcctgtatctgtattttctgcctttcgagattaagcactacctgcatctgcattttctgcataaggctacttttctgcctttcgacattaagcattgtatccatctgcattctcatcataaggctattattctgccttctgagactaagcattgtctctatctgcattttctgcataaggctactcttctgccttccgaggttaagctctacctccatctgcattatttgcataaggctacttttctgccttctgatactaagcactgtctccatctgcatttcctgcatttttgcataaggctacctttctgccttccgaggttaagctctacctccatcctatattttttgcataaggctacttttctgcctttcgagactacgcactgtctccatttgcatttcctgcatttttgcataaggctacctttctgccttccgaggttaagctctacctccatcatgcattttgcacaaggctacctttctgccttccgaggttaagcgcaacctccgtcctgcatttttgtgtaagtctaccttccagcctcccgagactaagctctgtctccatttgcatggctaaaatatcgccacttcttgcattggctgaaatatcgccacttcttgcattggctgagatatcgccaccttctgcatctcatgggctgaaagatcggcaacctatttaaagacatcatagtttggaggcactatctgcatggctcgagaacatcatttcatagcctgcgaatcttttattacgcacttcatggcccaaaacgtcatcccaaccgtccaaagacaacattcatggtccaaagggaatttgcatcacgtttaatttatgcccaatatatgttgcatagcctacttgcaggtacaccggctagcaaacgaccatcttagcaggagtgatcccactccggttcccgcagcctatcagatttcaaatacctcttgcaacctaaacatcacgtctgtccttttcaaacctccatcggcatattccgtcgatggatcctgaactacatatgacctgattcctgtaaaactagggatatgtaggcagctcaagagccagaactcggtcaaaatctttgcaaatcacctctttctctcaaaattggccatcctatctttacccgataactccttcttccttcccgggtaaagaggggtagttgttgatacctaactttttcctaggtatttttgtacccaaaatactttcaaaaggacatatatgtgcatatatgagcatacccaagtgttttggtatttttcaaaatttttaaagattttttaaaataatttattgtctattttaatactacaaaattcaataattattctcaaaattatcattttggtgaataattcattttactctcatatttatactaaaatatagtttaaataaattttgcacattttttacgcatttatttggcattttgaagctaaattgcatataattacaattatagcctattttacaattaattgcattttataattataaaatcatatccaatatttttagattaatatttatacattattagttagttcagtattttttaatctgttttaaaatctttttcactatttttataaaataaaaagggaaatttggctatttaaaatctgacctgtttttatttcaattatagcccaaattgattcccttattaacccaattttagaccagcccaactccgattaaacctgacccatacctaattcaactacctggtccagccttgattcgatctgagccgttgatcaaatgagatcaacggcccagatttattttcctaaattaaaacctctctctctctctctctctccatatatatatatatatatatatatatatatatatatatatatatatatatatatatgtatatatgtatgctaacatttgttattccttctgtctagaaccttctggttctctctctcgtctccgatgaagccaccgcctctccggccatctccatccttacttctctcgactaccaaccaccatggaacggtatcttgattgattctatctagcttcgagactccagaggcttacaccatacaagatggtcaccaaaggccttgcctggcttgtctccggcctttttccgatggcttatagtccgatggtactacgaatgccattattaacgagtttcacaaacaggttccttatctctcactgatttattgcgaaaccataatttctgcctaagtctcttaatctctgtcttttaaaatgattttcaacttattcttcgtgttttacactactctctacttaagttttcaacgttttgttcttcttttcaaaactagggcttctgaaaattgttttcttcaaaatgctttctagttttaagtgtttaacctgatgtgtctatgagtctttattgattttgttgggttcttccttaaccttaaccagcctatgctaaaatcccccaattttttgaaactttgttcggattctacactcgtccgtgttatttgatacatgcctatgtcatgtgctttgatttatgtgattacttcttcgtaattagaatatcttgtgattttttgccctagtatgcctctatcaaggtttcggattcgattctttccgtttatatttggcttatttgtttattcatggaaatctatgttattttccctaaatcagtgttgtttcgaatccttgattcactgaattgttatggtaatacctatgtgctgattctcgattatttccatgtattttgcaaccttaattagtttcttactttattttgattaaccgtgttacttattgattctttagtaatggtttccttaattgaaccctggtgtatttacccttaattgtctaccatgtgcccaagtcttacttgatcttctttccttaaatgtgttatgctcttttccattggctaattaccccttaactaagggaagacttgttgattccttttgcctgactgattctgtaacttccttgattgatgaaaattgatttcctttaccttattttactatgctctgaactacaatatgtactctcatctcttctcacttcccgacacgaacaaaattcattgttctgaactatctcttacacaaaacatactcagtgttctctcttgtttctacacaacctgtctcactttccttgtgactactgattactcagtcggcttaaagccaagactgagtgatttaggttgctttactgttctactattctttatattgctacctgatttggtctgcatactgctgtacacttctctatgtattatttctcactactgctctatactatctcatcctcgattggtatgccctccatttgatttacagctctcaaaacaacatgttttctattccttctgtgcttttacttgtggttctgttgttcttattgcaattagtatgttcctgtgtttagttcatccttctcttaacctagcatgcctattgattgctcccctgccataaccagcatgtagtcatgacccccttttgtttgaaacatgatgtgactatctaagtttttgaaatattacttgtccccatcccccttttcctatttgtgtttacttctctgaactatatgtgatgttgtcagaattatcacattgtcttctttcaaaactgcttctgtatggatcattctcctaaactatttttttttcaactcctttgttttctttaaaaaaaaaactatgtcactctctcactactcctagagtttaggtcctacccccttcgtgtaagcattgccttgggtacctcttgagaacccattgaagtttgatgcacaaggatggtaattccacactgcacttgttcaatggtccttaggaagctttgtcgcacccaaaccatggcaaagggctgtgaaactcgaaagaagtaaggttagaagaattgggcctggttgaaggcccctatagagtaacttcttatttttttttctttgattatgtaattcagctatcatggtttgtgataatttgtgaacaactgatggggtctagagtgaaatgggtggggattatgcatgttttggtttaattgatgggtagataatatgtttatggggctttaccttacttatttgtgcaatagaaactatgtgtaggacatgcatttttgcatatagatatcctatttaggctttttactttaagattatcatactcacctcgtaatcaattaggaattaacaaacaattgtttcttttcttgaaaaatttagtactgcatttagagaccatgtttaggagcttgtgtgcattagatatcatgttactttggacttttgtttcagctgggttgtaattactgagcgcctcactagttgcttatttaataacacagatttgggctaaaccgcgtcttctctttaaaactagattagtatgcatgttcacctttaaggtaattaggcaatgaataaggcacctaggcaaggtttaggtctaattaattaatcacgcttctgattactgagcctctttaactgatgaactacagcccttgtttataatttattttgttaaaactccagtcgcatttttgtgcctctatttttctactgagttgtttacttgtccagaattgtgctgctagtaggttactgcaaaccctattactgtatttttggagtatgttttaaacaatgtttacctatactactgcaatcttttgtttctgaaaatcagaccttcttcaaggcacttaattttaaaccttagacttcttctgcaacttatcttttccgtccttcctgttttaaactcctttagaccttaaatgtgtttgagatgtgctaactgcatgattatttgtagagggatttgtgagcctttcatttgcttccttgaattattccttttatgggtagttctacttgttatgaatggcgcctagtattttgtcctttaaacctaatggttcagcctagtccttaccttgtaagaatagtggtcctaataccatctaggacttataggatgggacgggtacaacacgcaataatcattcgtgaccaattcacacatttaaataacctttacggggtggggaagggtagaatatatggatatgatgaccggtgcgctaatatcacgtgtgacccctcttttgaggagtgtacaccgagtattgcattgatgtgatccatattatttgtaaacctaggacccccttatcccttttacttgttattttttcctaatttgttcaaactatatctctaaactttctactcttttatttttcaaactctcaacttgcttgcaatattacgtgaaaacccctttatttgagacttctatttgcttacttgttattcaaagtcataattgtaacatggtcgggaccacaccagtggatcttgagggatgcctaataccttcccatcgagataatttctagcccttacccgaactctggtttcttcatctcaaactcttcttaaaagtgtcctaatgcactataatcattaggtggtgactcttcaacacctaaacccaaattctcgaaagggaatagagttgacctcccaaatatcgtaaacctgatttcgactcttagaaaaagggggcgttgacaagcgtcactttggcatgcatattccgtgtaaaacgagctgtctctcaggctggaggaggagccttgactcctactactcgcactccgtagcagatggctccctagtttcagaccccggcagctcagccagttggggtagttcaaccgggtattgtggcacagatcagtgatgggtcagttaggaggtctattgatgctttatggagactggacaggttctccaatccttttactactacatatggcgctacatctcagaggatccccgggactatttggacagctgtcataaggttttatagaatggggtcgactttactgcttttcgtctattaagttccgccaagacttgctggagggattattgtttagctagactagttgggtcaccggctttgacctgggatctgttctctcatctattgttggagaagtttcttcctatcacttagagggaggactatcggaggcagtttgagcatctccagcagggttctgtgattgtcacttagtaagagactgaattcatcaacttggaccgtcattctcttcttatacttcccaccgagagagggtaaggaggtttgttgatggagtagctcagtctatcatattgtatatggctaaggagacagggaatgagatttctttccaagatgcaaccaatgtggccaggcgagttgagatgattatatcacaggggagtgattaggggtctcacaggttcagtggtgattgtctggagacatggattcttttggtagaggacatcctcccaggccatttgattcaacactacaggcttctcatggtgctcgaggtggccattgttctcatatacagtatttaaatcacctaccctatagtgtgttaccagcttttatctgtgcacctccgctccagggctttcaaggtggttacttaggttgtcaaggtcagtttcagggtcaacagttccagcacccgaggacttgttatacttatggagatccgaggcacatcgctagatttttccttcgagaatttctcaatatcatggttcttttgccatggtttaggcaccgggtgttccaccgcctgctcggccaactagaggtagggatcaggcagctagaggtggatgccaaggtgttagaggtggaggtcaggccgttagaggtgaagataaggcaattagagttggaggtcaggccgctagagatggaggccatcccagggatgtagttcagagtggcgcgatggaagcgtggtgggtccataactcgtaggtcgcataggtaaggtttttgtttgcagtagagatgcttcagttctatttgatccagggtctacatactcatatgtgtcatcttattttgctatgtatttggttgtgcttcatgattctttaagtgctcctgtatatgtgtctatcgctcgtgtgtggttattattgggggtcttgagacctgtgtagatctcttacttctggacatagttgattttgatgtcatattagggatggattggctatatcttatcatgctatattggacttccacgccaagaccatgaccctacccgtgccgggtttgcctcgattggagtggagagggactcttggtcattttattagtaaggttatttcttatatgaaggctcgatgtatggtcgagaaggggtgtttgatttacttggcgtatgttcataattatagtgccaaggttccttctatggattttgtgccagttgttcaggagtttccagggatttttcttgcagatctaccggggatgccacccgacagagatatcaacttttgcattgatttggctccgggcactaagcccatttctattctgccatattgtatggcccttccagagttgaacgaattgagggagaagttgcaagactaggttgataagggcattattagatctagtatctcaccctagggtgcgctggtgttgtttgttaagaagaaggatgggtcaatgaggatttttatatattatcgacagttgaacaaggtcaccatcaagaataagtatccattgcagaggattgatgatttgtttgatcagtttcagggtgccaaagtgttttcgaagattgatttgagatatggctaccgtcagttgaggattagggcatccgatgttcctaagatagtttttcgcgctaggtatgggcattatgagttcttagtgatgttatttgggtagacatatgccccggtagcttttataaactttatgaactaggtgttcaagccttatctaaattcctttgtgattgtcttcaatgatgatattttgatctactcccacaaccgagaggagaatgagcagcatcttcgagtcattcttcagactttgagagacaataagttgcatggtaagtttttgaagtgtaagtttttgttgagttcagttaccttcttgggtcacgttgtatcagtagagggtattcgggtggatctaaagaagataggggcagtcaaggattggcctagacccatatcagctatagagatccggagtttcttaggtttggcgggttattaccgtcgatttgtggaggggttttcatctatagcagccccaatgaccaggttgacccagaagggtgcccagttcaggtggtcggacgagtgtgaggcgatatttcagaacctcaagacaactttgactacggcgtcggtgttggtgttgcccacaggttcagggccatttataatttattgtgatgcatctcgtattggacttggtgcgttgttgatatataatgacaaggttattgcatatgcttcgcagcagttgaagattcacgagaagaattatccagttcatgatttggagctagcagtcattgtttactcgctgaagatttggtggcattattgatatggcgtgtcatgttaggttaatagatcataagagtttgcagtatttgttcaagaaaaaggatctcaatttgaggcagagaaggtggttggagctattgaaatataatgatatcaccatcttgtatcatccggagaaggctaatgtagtggtttttgctttgagtaggaagttgtgcagtatggacagccttgcatctattccagtcggtgaaaggccgcttgctttggatattcaggttttagccaatcagttcgtgatattggatgtttctaagcccaaacgtgttctatcttgcatagtcactcggtcttcgttatttgagtgtattagagatcggtagtatgatgacccttatttgcttgtccaaacatagtgcgtcacggtggtgccaagtaggtttacattttgatatgatggagtttagatgatgcaggtttgagtttgtgtgcctaatgtggatggacttcgtgagttgattctaaaaaaggcctatagttctcggtattcgattcgttcgggcgacggtaagatgtatcaggacttgaggcagtattattggtggaggaggatgaagaaggatattgttgcatatgtagctcggtgtttgaattgtcagcaggtaaagtacgagcatcagaggcctagtggtttgcttcagaagattgagattcctgagtggaagtgggagcgtatcactatggacttcattgttagactcccacgaactcagaggaagttcgatgtggtataggttattgttgataggctaaccaagtcagcacatttcattattatagcagtctcctattcttcaaagaggttagctgagatcttcattcgggagattgttcatcttcatgatgtacccgtgtctattatttcttaccgaggtacaatatttaccttacatttctaagggtcagttttgtgtgagttaggtacatgggttgaattgagcacaacatttcatcctcagatggacagacagtctgagcgtactattcagatatggaggatatgctccgagcatgtgttcttgactttggaggtttgtgggatcagttcttgccattagcggagtttgcctataacaacagctatcagtcgaacatccacatggctccttataaggcatcatatggtagacggtgttgaatgccatctgggtagttcgagggggggctcgattgtttggcacggatttggtacaggattccttggacatgttaagatcattcaggataagcttcgtacatcttagtccaagcaaaagagttatgcagactgtcaggttcgtgatttggccttcatggtcagatagcgagtgttgctttgggtgtcgcccatgaagggcgtaatgagatttgggatgaaggacaagctaagccctaggttcatcggaccttttgagattctggatcgagtgtgagaggtggcttacaaacttatcttgctgccaagtttatcagttgtgcatccagtatttcatatgaacaatctttggaagtagcacggtgatccatcccacgcgttagacttcagcattatccagttggaaaaggactggacctacgaggaggagccggtagctgttctagaccggcaggttcataagttgacatcgaagaaattcccttcagttcgtgtgcagtgtagaggtcagcatgttgaggcagcgacctgggagtctgagtcagatatgcgaagccgatatccccatcttttcaccgactcaggtacttttatttgttcatttgaggatgaaaggttgctttagaggaggagaatgtgatgaaccaaaaggtcatctcttgttttagaagtcaaatatgtgttctgaggtcttaacaactctttctattttgccttgatttgcgtgcgcgatcaaaatgctatttaggaaaacttttatgtgaaatttaagaaaaagattgattttgacatttaaattgattaaagttgaattcggtcaatattttcaataaacgaacccagacccattattagacaatctcgtagggtctgtagtaaaatataaaactttggcgtatgcccggaatcaaatttcgagttccctagcccgagaaaaaaaattttaaagaaaattatttgctgaaaaaatatatggacttttagaaatgaaatggtgtgtgatcttgatggtatcgggcccgtattttagttctggagcccggtacaggtctaaaataataattaatttaaatctgtgaaattgggtaagaattgaagttgatttggtataaatcatacccttagttgagaaaatgaaaatttcaatgttcttaagaatttcttgaatttaaggttaaatttatagctcttgatgttattttgattatttgatagcacgaataagtctgtatgatgtttttatacttgtgtgcatgttttatttagtgctctgagggctcgggtgagttttggataggccacggagtgattagaacttatgaaaactcagctgatgcatctgatgttttccacatgcctctgatcccacaattacgagatcaggcttcgcaatttcaaagtgagaaggcctaggaaatgtgacaataatgtcgcaaatatgaaccaggcttgggtaggctttcctcgcaaatatgacttttgggtcggaattgcgaagacccgttatgtctcaaatgcgacattttcatcccaaatatgaagaaagcagaaattcatagggttcgcaattgtgtatccctaatctcaacagcgataactacagcctgttaaagatttcggatgggattttcagcatttttcaattctctcaaaccctaaacatccctaggcgatttttcaaagacctaaacttttccaaatcttaggtaagtgatttctaactcatcttcttcaatataattcatctttttacatgatttcacttcaaaatctagggtttttaatggaaattgggtgttcttagatagatattacgtttttcaaaatttggggatttggacctcaaattgaggtccgatttcaaaatcaattttatatttgggttcgtgggtgaatgggtaatcgggttttagttcgaacttctagttttgaccaagaaagccacaggtcaatttttgactttttgggataaacattaggaaatctatattcttatttagcatttattggtgctattaagtaaattattgctagatataagcggattggaagtggaactgagaggtaaagtggtaattgaggcttgattttgtctgtggaattgaggtaagtgtttggtctaaccttagcttgagagaatatgagttatggtcttatttgctacgtgttagtgttgagtacgacgtataggtgtggtgacgagtatctatatgttggtgtcaagcatgcccgtgagtgttataccatgatttttgtgactcgtattatgtatactccatgcttaaattgatgattattaatgttgaacaaggcttatgatagtttattggtaaatgatcattgttgagtactggctcatgttgagagttattttgtgaagtaattgttggaacaagattggttatagctgaatcccttgccagtatatatttttttctattattaattccctagccaggatgtattgtttatattgtttgggtgaggaagggtaatgtcgtgcatgatattgtgagtaagtgttaatgcacgaagggtgatatcgtgcacgatattgtgagtgttaatgcacgaagggtgatgtttgatcgctacctactccgcactattaaaaagtaggaagagacggtcgcaatagctttcacccgatttgtgggttgggatcgaattccatagagagctaggattatagttgggtgtctattcagatttggattgcgttggttccaaatatcacttccaatcattttttgtttttctatataaaactactattatcaaacaacaacttaagattgaaactagattatgctaagattagattgctacaagttgtatctaatggattaaggggcactagggtagtgcttttcacctaggtggccaattgacgggtaattgcttctaaggctcgattgacatgatcggggaaatatgttataaccattgcatgactttaaccgctctcacacctctcagtagagagagtgattttgctcaattaactatctcaagaccaaatgggtaggcaaattagctcaaacaactagggttcaagtcgggtaattactctctcgaggtttaacactttaattgggactatcaattctcttgagtcaatcccaattccttgctgggtaaatttttgagacttagtctctctctctcaagaagatccaagtcaacttagcaaaagccagtatttgcaacaaccaattcataaattaaaccataaaattgacccaaataacaaacacccatagtcaatctagccctaaatcacaacacccattaattacccacactagggttgagccacagatctagctaatgggtctacttactcatgcttaaagataaagacaaagaaatagatgaagaagaagacacattaattaaatactaaagtaaatacatagattctatcgttcaatataagttaaaatgcccaaaatggctacaatatggattctcacgagcgcagctgaagttctatattatctgatacccaaaaaatggaaaaaggttctatttatactaagttggaaaaactggacaaaaatgcccttgcagggtcagtgcgggccgcacaaaatggatcgcggtcgcggaggcttctaatgcggtccgcacaaacatgatcgcggaccgtgctggcttgaaccttggcaatttagatctctctaatcttcgcctctgcggaccacgcataatgttagtgcggccgtggagccttcaatgcggaccgcaaaatctccactgtggtcgtactacattgacacttgatttgtcagttctctgaatctcccttgtacggaactcacaaagtgtagtgcgaccgcactaggcctgtttgtcctgagtttgccttgtctttggtacttgtgtaggtttctctccttttgagccgatctttgatatctcatcactttgtcgatcaaacctgcaattaagcataacttatgagccttttgggataattttgtaagaatttatactcaaagcgtaaacaagaaggagcatgaaacacgtcaaaatccctagttatcaactcccccaaacttaagcttttgcttgtcctcaagaaaataaaataagacccatcccttaagggaaaatccaagtattttcagctatcctaaagtggcctcaactagaatcaattggaactaacaattgtcctcaatacaaatagatcattagtaacatttaacctttgaaaaaccatggatcaagtgtgacacaagagcatcaagagttgactcattacagcaaagaactctcttaattactttggtcattgtggaacccaaactcacacatcatcaactctcccaaagcaaacctcgccttttagagtattaacatacaaatcgaggtcaatgggaattcactcatctctctcaagaaaaaggtcacaagtccgactctaagtaccatatgcttgccccttatataagtatccactaatgtaagcttcattcaactcaagatcatatagggattttgtggagttattgtgaaggcctttggttcagggtaggaaatgtttttatctaaatgggttccatcttcccttaagcacttcttttgattcatttggcacacattctcttgactctttgagtcatcatacttctttctaaggggttagagagacacattgtcactctttcttatgcaattgaaaccatttctccttttttaactttccacacctttcttccttttgcttttcttgaatccctttttattcttctcacattgagcattcgttttgtcttttgcttttctttctttttcattgcctttccttttcttcatttttatgcctcataccactttgttgtcatcctcgtctctccccccccccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcttctctattatttctgtagtttctacttcttccatgtctagctaaacccattagctagggttgtggctcaaccctagtgtgggtaattaatgggtgtttttgcttaatttgtggatgttgattgggtgtttggatttgggttgtgtgtatgtttttactatgatttggtggttgcaaacactaagtcaagcttagtgggttttgactcttcttgaaaaagagagtctataacctcactctcaacccactaagcttgacttagtgtttgcaaccaccaaatcatagtaaaaacatacacacaacccaaatccaaacacccaatcaacatccacgaattaagcaaaaacacccattaattacccacactagggttgagccacaaccctagctaatgggtttagctagacatggaagaagtagaaactacagaaataatagagaagaaagacataatcattaattagaaggtaaatctacttgaatccactttggttacataagatattgcctaaaacatgctaaaataatggctcacgagcgcagctgctagttcagagcataaaacttatcctaaaaagtaaagtgttctatttatactacacagtaaaatctggacaaaaatacccctgagggtctgatgcggaccgcaccaaaatggtgtgcggccgcgcaaggggtaagtcttcaattcagctgctgcctgagtagagggatgcgaaccgcaccaaaatggtgtgcggacgcatagggttggcaatgcggaccgcaccataatgatgtgcggccgcacctgaagacttgacaaaaatactccttctctgaacatcgaacatgcggaccgcaccaaaatgtcgtgcggccgcattgatctttgtctgaaagttcccacttctgattcctcgagcaggcggaccgcacaaaaatgagtgcgtccaaactaggccggttcccaaaaataccagctctctgatagcttagcatgtggccgcataccaaagtggtgcggcccgcatggcctcctggacttcagccatttcactgactaatcatgtgcggccgcacaccagaatggtgcggtctgcacatagccttgacttccacatttttgtcaactcttatcgcttggccggtttcactcctttttgaactgatttgtgattttcatcatcttgtcgctcaaacctgcaatcaagcacatttgtaagtgttttggaactaataggaggcaaattaagcgcaaagctaaggtaagaagtggcataaatcatgtacaattcacagttatcaactcccccaaacttaaacctttgtttgtcctcaagcaactaaaatgagacacatccctcaatagagaacattccagaaattcctatttttcctaaagtgacctcaacaagcctcaattggggctaacaattgtctccaatgcaaatgaatcattaacagttttaaaactttgcaaacttacggatcaatcatgacacaagagcttcaagggttgacacatttcgtcatggagctttttctcaagtactttggtcattgtggaacctaaactcgtacatcctcgactctccctaagtgaacctcacctttttgaatatatgcacgcaaattgaggtgggaaactctctcactcaatcactcaaaaagaagagaccctaagtccggctctaagtaccatatgcttgccctttatgtaagtatccactaatgtaggttttcctcgatttaagatcatgtaggacttttgaggagtcatcgtgaaggcttttgggtatgggttgcgcaattgttcacattggttcaatcttcccttaagcgcttcttttgtttcatttttgcacaatttcatgactcaaatatgcacttcacctctttaaagggggcagagagacatgttgtcactctttcttttgcatttcaaacctttttctccttttttctactttttcaacttctttcaaccttgttcactttattgatgtactttgattccctttttgattcttattctctttttgacttccttttttttgtctttttctctttttcattgccttccttttctctttgcttttgtacctactaccacatgatttcctttcttgtctctccccccaaacttagacatttgtcactactcaagggaatatttgggtgccaagagaaggtttccttaagaacgggtataggcatgtaatttggtttgaaggaacaagatttaaggctcaaaaggggtgaactagggatcttggtattggtgggtcatgaaattggttgagatagcatttttggatcaaagagggcctacaatcacttctcaattcaagttctacctatgatttcgcctcaacaaacattcggagtaagttctacaccatcggctcggcacttgggctcgcaaatcaaactctcaccacactaacactcaaagattgccaaagatggagtcgagggcccacaacgaccttagatatgatataaacgcacaatggcctcacacgaccatatgacggttgctttgtcaacacaagagtttcaaggccatgactttcaccatcctaaactcaacttgatgtctttgaccataagatcgaaggcaaatgtgctagacccaagtgaagcgttgcctgaggtactctcactaaaagaacttgaaaaatcaaaaagaaacaaaacaaaagaactgactcaacccttaagaaagttgtcacgctatctatcattgggaagagtcacccggttcacacaacattctacccctagaaagaatcgtggcattaagaaaaccaagggcttatttcacaaaaccaaaccaaaagaagaagctacgagcctaatttagcactaaaacaaaaacttttgctaaaataatgaaaataataagaaaactcaaacgagaaccaaatgaatatatacataaggggagtagaatatacaactaaagggagtttcagaatttaaagttatatacaaatcatctatctatgaaaatgcaaaaagtaaataatcaaagtatatacagtcatccagaatccaataaataaacaaaaagtagggccacatccccacgaataaaagatagcattgtccccaatgctaactatcaaataagcataaaataaggggggaaggaagagaaatggcccctcaagcctgatccacggtagtctgctgctcagtggtagttgtgccctctgtactggtggggacctcagaccggtttacaacctgttactgctgtggtgccaggacattagctgtctgctcaggcggtagtatctcagctgcctctccaatgctgggctcaggtgggccctctagtgccggatccatctctatcactactccctcaatgcgtgggagctttctcttcttcctcggcctcccctcgggctgtggctgagctgctgctgctgctgctgcctcatcaactggctctccaagtagtaaatcaaggggcaactgatctttcagaatcttgtccacatcttcccttagcttcttcatagagtctttggaggccctatccttccgaagcttcctgtgctccttacctagctccttgaggtccttgctgtgagctgccactgctttctccaagtcgtcctgtttcttcatcatggcttcctggttctccaggatcttcttcagtatatcctccagagaagtaggaatctccacagtgacaggtgccctctgagtctctacagctgtagacaatgtggacaacttggaagtcgcagccgacatccagttgttcacactagccaaagtctgagtcagctggtatgcagtcagcccacaagtcttggacaccgggaccaccggctccgcagaggtggaaggaggcactggaagctgtacagatgcaactggctcatcagactggccagctgcagtggaggtcgatgcctgccctttcttggcggccttggggttgtccggccccttttgatcataccacgaatacgggcccattgggtgcacctccgtgtcatagtgcttcttgactactttcatgtagtcaaagtatatggtcagggtgttggggaagggatagttgtgatcagttgaccgccccgctctattgatttccctttgcatgatattccccacattcaatgggaaacccgccataatggaggccactagaactgcttgctcgataggcaccgagttttcatgagtggacgggtcaagcctggaacatacaaatgaaagccaccctctcgcctcgaaactcagggtgttcctgaatatcctggttggaggagccaaccatgccgggacagtgccgggagctgccatgatttgagctaaccacgggcgcacgtcctctttctgagctaacttctccagatattgggactcatcttcctcctcgaatcctaaaaactcattcaaagtcttgccatcatacaagactacctggtttctcactttagttgttgtggcaccctggactatgtggtgaacattgctgtagaactccttgaccatgttctcattggccatgtccaccatttcagaaaaatgtccccacccttttcttgtgacaaactgggtatgcacatgagggttgtgcggcagcaagtcagctataatgaatctccgctccaggattaactttctcaacggccaccaagatcggaatttcctgaaggctattgggctaacaaaccgctccttccatacctcctccttctttgttctctcaactcccccgacttgtggttcaccaccttcgctctcttcccttcactctcctccttttcactctctccctttttactctcttcccctacactcgcttcccctgatgatgacattatgggggaagaagagtgctcttcctcattctgtttttcagcctcagactcatcagacgagtccgaaactacatttctcctctttcgggatgaggccacattttcttgttctttctcttgagatgaggatactgctattggcacttcaattgacctcagtgaagcaatggattctgaggttatactcttggaaggggcatattcactgccggaggaatgagatgcagctttgtctgcagccctgatcattttccttgtctctttcatttgcttcttttctttaggagtgagccttattactctccgaaccatctttgttctaggctcactcccctttgccggttgtttatccttccccccgcgttgtacttgtttgccattcggaggcattatctgcataagaacatcatctatcattgttagtaaaagcacgagaggcattacacatttgcaaattcaaaacagatggcaggtgaagtcatttcagatagccagatgcggccgcaccaaaatggcatgcggcctgcactggcaaggaacaccccaactgagcagtctcagaactacccatgcggcccgcacaaaagtgggatgcggccgcatgaggacctagtgcggccgtaccaaaatggatgcgagccgcacatgtgattatcaaaaaaagttcatgtttcagacaaactggccatgcggtccgtacagaaatggaccgtggccgcataggaacaactcacaaatatgcatctcttagacaaaaggtgtgcggcccgcactgaattgggatgcggccgcacaaacaacctttaaaatgacacctcctctgatacagggccaatgcggtccgcacaattttggaccgcggccgtgtggggaaatcatgcggctcgcacaacaatgtgatgcgtccgcgaggagggttcttagaaaatcaagcaaaacgtgcgacccgcacaccaaaatggtgcggccgcctagggcaaaaattgctaagcaggagcggtttctttgcaactttaagcatcaaataaccctagattttgtccccactcgattttacggtgttttggcttatgcccatgcttggaaacaaattacacatgaagctatatctaatctaaggcaaaagagtgaagaaaaagaaaattaagaagctaatctaacaggaaagcatgtaaaactaaaaagtaattaattaaaaacttagcatggatctgaggaatgttaccaggtgtatgtagaagatgagatgataaacactcaaatgaaaaacaggagatgaacagtagcaagtaggctttagagtgaaaatttgcgaaaagtgtaaaaagtgagcccaccggtctatttatagacagacggtggggcccagtcctacctacctgtgcggccgcaccaaaatggcatgcggtccgcacaggatttttccacctggggttcaaacagcccatgcgggccgtacaaaagtgtgatgcggctgcatggatagttttcagagatgcacagtcgaccctgatgatgcggtccgcataaaatttcaatgcggccgcactaaggtcttatcagacactgccagttttccttttgacccacgcggaccgcaccaaaatgccatgcggccgcgtgggtgtttcttgtgatttccagcctacttaggcaaccccatgcggtccgcacaacaatggggtgcggccgcacaggcactggacagagtccttgcactgtttaaccttgatttcgtgcattgattcacacctaacctgcaacactccacaaaccattagctaaaaaatcctatcctacaaaagaaaaattacacaaatgaaaagacatgggttgcctcccaagaagcgcctgatttaacgtcgcggcacgactcaagttaccatcataatcatttcaagtgaaggagcgccaccacatggctatcatcaaactttcccaagtagtgcttgaccctatgcccatttacccggaacacttcgccattcttgtttttaaggtcaatagtaccaaaaggtgtaacaccaaccacctcaaaaggaccgctccacttggatttcaacttttccgaaaacaacattaatcgagaattgaagagaagcaccatatcaccaacattaaactctttccctcgggcatacttgtcatggagatatttcattttatccttgtacaaagatgaactagaatatgcatgaaatcggaactcatcaagctcattcaattgttcaaccctgagatttgccgcaacatcccactctagattcaactttttcaaagcccacatagctttatgctccaactctacccggagatgacacgctttaccaaaaaccaaccgatatggcgacatgccaatcgaagttttgaaagccgtctgataagcccacaaagcatcatccaatttcttcgaccagtcggtcctgtttgcattaaccgtcttggatagaatactctttatttcccgatttgagacttcaacttggccacttgcctgaggatggtaaggagttgtcactttgtggttgaccccatatttggcaagtaaagagtcgaaagcccgattgcaaaaatgagagccaccgtcactaattatggcacggggtgtgccaaatctagtgaaaatgctcttcttcaagaaaaccaccacactacgagcttcattattaggcaaagcgatggcctcaacccatttcgatacatagtcaaccgccaccaaaatataggtattgccacaagaactcacaaacggtcccataaagtctatcccccaaacatcaaaaatgtcgacctcgagaatcgtgttaaggggcatctcatctttctttgaaattcctcccgcacgttgacactcatcacatcttttcacaaagtctccggcatctttgaacaatgaaggccaatagaacccacaactcaacaccttggataccgtccttgccccgccatgatggccatcatagggcgaagaatggcatgcttccacaatacatagttgttcttcctcgggcacatattggcgaattacaccatcggtgcaaattttgaaaagataaggctcatcccaatagaagtccaaagcatccttcttgagcttcttcctttggttagaagagagctcacacgggaccacaccggtaaccaaataatttgcaatgtccgcgaaccatggcatgtcaagcatagaaactgagagaagttgctcatccggaaaggagtcgtttatttcaagaccatccgaaggcctcccctcctcctccaaacgagacaagtggtccgccacttgattttcggtacctttctatccactatctccaagtcaaactcttggaaaagaagcacccatctcataaaccttgctttcgaatcctatttagtcatcaagtaccttagggcagcgtgttggaaaaggatgcaaagtatgtatttgatgagaagtgcatggaagcatttgagcttttgaaacacaagttgacgactacccctatcattaccgcacccaattggagcttgccctttgatctcatgtgcgatgctagtgatgttgcggtgggggaggtcttaggccagaaaatcaacaagctattccatccggtgtactatgctagcaagaaaatgaatgaagcgcaaagaaattacacaattccttctcggtgactgtgtaatttctttgcgcttcattcatcgtcttgctagcatagtacaccggatggaacagcttgttgattttctggcctaagacctcccccaccgcaaaatcactagcatcgcacatgagctcaaagggcaagctccaattgggtgcggtaatgctaggggtagtcgtcaacttgtgtttcaaaagctcaaatgcttccatgcacttctcatcaaatacatactttgcatctttttccaataacttacacaatgggttcactaccttagaaaagtctttgatgaatcttcggtagaaacccgcgtgtccaagaaaactcctcacccctttgacagagttaggggcaggaagcctcgaaatcagctcaattttagctttatcaacctcaattccgttctttgaaattttatgacccaaaacaattccttcttccaccatgaagtggcatttttcccaattgagcaccaaattagtatcttcacatcgggccaacacacgatcaaggttttgcaaacattcaccaaaagaatcaccgatcacactaaaatcatccatgaagacctccaatatgtcctccaccatgtcggtgaagatagccatcatacatcgttggaaagtcgccggagcattacataacctaaatggcatccgcgagaatgcgaatgtgccataaggacatgtgaaagttgtcttttcctggtcttctggggcaataagaatctggttatagcctgaatacccatctagaaagcaatagaatgcccggcccgcaagacggtcaagcatttgatccaagaacggcaatgggaaatgatccttcctcgtgaccttgttcagcttccggtagtccatgtaaactcgccaacccatcacagtacgagttggaatcaactcattattatcattggtaaccaccgtcattccacctttctttggaacacattggaccggagaggtccatgaactattggagatcggatacaccacacccgcatcgagccacttgataacctctttcttgaccacctcttgcatggcctcatttactctcctttgatgctctagataaggcctagcatcctcctccaatatgattttatgcatgcaaaatgcggggctaataccccgaatatccgctaaggtccatccaattgcccgcttgcgcttttgtaaaaccgccaaagtggcgtcaacctgcacgttagttaagcaagcagaaataatgacaggcaaagtgaaattaggaccgagaaactcatacctgaggtgaggaggaagtggtttcaactccaacaccggtggctcctcaatagatggtttggtgggtggagttttccggttctcaagatcaagcgatagcttccttggctcataagaatacgagcccataacataaagtgcattgacacactccaccctctctggaatatcatcaacatccatattcaagatcactgcctcaagtgggtgttcaacattttccattgagcttgtgtcatccactatcactgccgtgacaatgtcaacaaacgagcacacttcgttgctatttggttggcgcatagacttgcatacatggaaaaccactttttcatcaccgatgcggaaagtcaattctcccgcttccacatcaaccaaggccttcccggtagctaagaaaggccttccaagaataatgggcacctcgaagtccacttcacaatctaagattacaaaatcggccggcaaaataaacttgtcgaccctgacgagaacatcatcaataatccccaaaggtctcttcatagatcggtccgccatttgaagcctcatggaagtcgggcgaggttgcctgattcctagagttttgaacacagaatacgacatgagattgatacttgcacctaaatcacatagtgcctttgcaaaatcggcactcccaatggtacatggtattgtgaatgcaccgggatcctctaactttggtgccatggaatgaataatggaactcacttggtgcgtcattttgatggtctcacactccatataacgcttctttgtaatcaagtccttcatgaactttgcataaccgggcatttgttccaatgcctccaccaaaggcacattgatggtcaaacttttcatcatttcaataaacttcttgaactggttatcccctttttgcttggccaatctttgaggatatggcggaggaggcctaggcaaaggtgccttggcttttggcaccacaggttccggcatgtcaatgacgtgttccctagacgggttcacggcctcttgggtctcctcctctcctttatctatatcaattctcacttcatttctcacacttggttcaaccactattggagaatcatcttcttgtacttcctcctcatcgaccctcacttgatcgtcttgcacaccaccacctctaccactatgcgtagtcacgtccataacatggttgttgtgcccacccttaggatttaccatcgtatcacttggtagtgcacccttcgggctagtgttgagggattgtgatatttgaccaagttgcacttctaagttgcggatcgaagtgttatgggaggcaagttgggcatccgagtcttggttctttttcattatttgttcaaacatgttttcaattctacccaaatcttgacccgaccaactttgcccttgagattggaacagtggtggattgtttggttgttggaacattgggggcctttgaaaaccttgccctcgattgccttgatttcctccttggccattattccatccaccattgttgttgttgttccaattgttgttgtttccgccccaattaccttgattaccccaattgttgttttggttgttattccaatttccaccttggttttgattattattccaattgccgccttgttggtttccccaattgccttggggcctccactattgatttccttgaccacctctattaccttggaagttattcacacattggacctcctcgctttggccctcgtacccatcatttgaataacccccatttccatcatcataatcatcaaaactatctggaggttgttgttgttgttgtcctcttttccttcttttcatcaaattcaccccctccatagcatttacttgacgcggactttgcacttgttgaaactgtgccttggccaactggttcaatatggttgtaagttcagttatggcttgcccatgatcatgtaactccttgtgaaagtgtataacattgggatcaccctgaggaacattagcacggctttgccacaccgttgaagtatcggccatttcgtctagaacatcgcacgcctcatcataaggaagtttcatgaagttgccacctgccaactgattcactatgcactgattggttgtattgatacccctgtagaaggtctgctggatcatcacatcattcatatcgttgttaggacactctttgaccatcgtccgaaacctctcccatatctcatgtaggggctccgtcggctcttgcttaaaagtgaggatgtcatctctaagagccgccatatgactgggcgaaaagaactttgcaatgaatttatcggccagctcatcccaagtagtaatggaattctttggcaatctctctaaccaatctaaagctttcccctgatgtgagaagggaaaaagccttagcctcaatgcatcttcagaagcatttgtttgcttactcccccaacaagtatccacaaacccttttagatgcttgtaagcgttttgatctgaagcacctgtgaagtaccctcattattcgagcaaagtaagcatgacattggtgatttggaagttccccgcccggattcggggaggaactattgcacttgcataaccctgattgggtaatatccgtggtgcacctctcggaggtggtggtggtggggggtctggaatgttgttttcattagcattcaccggagcatttgcatttctaccccgcctttgtggttgggggaaaacctcttcttgctcaacttcttcaacctcatcccccaccacattaccaagaggatcttgtccgtttaaatccattggtacctagatgaaattgacaaacaaaataagtaacaagaaggaaagagaagcaaaacacacaactagccaacaaatagtcaaacaccgtaaagctccccggcaacggcgccaaaaagtgattgtggaaaactcaatctgaagaatgagtgggctcgaatactaatacccaatagtgtatcggggtcgataattccgcagggagcttcaatttggagatgagtaaatgtatggcctagaagtatgttctagcttctaattggtcttctaacatctttgggtttttcaagtattagtatctaaaatgttcaactactatgtaaaagtagaattatgctaagttatgctaatattaggtgtatgcactaagagagaaaggcactagggtcgtgacacttacctaggcggataatcaatgggtataagattctaacacgaggatgttaaatatggggaaatttctgaagacccaggttcattaccttcactggcggataggtattgatcagactcagaattggactcagtggcttttgctggattttctttctgttgaaatcgagaatcactggatcaatagttggtttaaacccaagagtaaaatggtaaagtgtaaacgaaagaaagtccagtcatataggaagtaattctctgatttggattggggattacgataggaaaatcactactccagtgacaatctttacggactatgggagctaaaacttctgtaataagagtaggataaacatcggcacgatctaagccagcaacttttctatcgagtgattgtctatcatggtgaaaagataaatcattgggaactatctcctctaccaaaggctcctacaaaggttcagaggtctccttacccttggaagaagatctttgaatgaaagaacctctagttccaaccttgagttacttaggcaaattggcctacccaattggtctcgagagagtcaattgggcaaaattgttctctctaccaagaggtgtgagagcgagtactatagtgcaacggttatccatattccccatatttaacatcctcatgtcagaatcttatacccgttgattatccgcctaggtaagtgtaacgaccctagtgcctttctctcttagtgcatacacctaatattagcataacttagcataattctacttttacatagtagttgaacattttagatattaatagttgaaaaacccaaagatgttagaagaccaattagaagctagaacatacttctaggccatacatttactcatctccaaattgaagctccctgcggaattatcgaccccaatacactattgggtattagtattcgagcccactcattcttcggattgagtttgccacgatcagtcatctatcattgggaagagccaccgattcatacaataatccacctttgaaaagaaccgtggcattaagaaaatcaaaggcttattgaaaacgtccaaaacaaaacaaaaatctatgagcatatatatgaagctataaatgaaatgtttttgcgaaaatagaaagaatatatacaataggggatttgaatatacaacggggaatgaatatatacaatgatgtaactttatatacagaccaaaggaaagataaaaagtgcgataaaagtaactaaatgtaaaattatatacagaccaaataaaaatcaagaaagcataaaatgaatcagtatatatacagtcatccaaaaatatagggcgcaccccctcaaataaaagttggcattgttccatatgccaactaaaccaaataagcaccaaaaataataaagaaaggatatgaagactcctaagccgtgtctgtctacataggatcatgggaggtccctgggtcctctgtgtgctcaggaacctcagaagagttcccggtaacttgctgctcaactactgggacctggacagggacaggctcatgctctggtacatcctgtggctgactggaggaagcctccggtgggtccgccaactagatgatggcatcatctgctctcgagatcctcctcctctttagatgcctctataactgctccggttgtggctcaactactggaactgggtcctcaaataatagatctaaaggcagctggtctacctttaatttatcaacatccacccgcagctctttcaccgacttcttggaggcccgtatctttcgtaactttttgttctccttagcaagctccttgagagacttgatatatgaattaactgcctttgccaaagcatcctgggtagtgaggattttcttctggttctgaagaatctctttcagtgcatcctcaatagattgtgggacatgcgctggctgaggtgccgattgaaatgcaatagtggtggtcaactgggatgaagcagtatacatccagttgtttagactctgaagcatctgactcggtctgtgggaagtgatatggcgggcccgggaagatgggatctccgggcctgctgatgtggaagggccaggaggattggctgaagtggaaggtctgggaggcatctcagcagaaatagaggcatgctcagtgggggcctctaccacaactggctcttcagtctggccagttggggcagaagcagggaccttgttgttcttgtccttggggttgtctagccccttcaaactataccttgataaaggagttgttgccttgaccttgatgtcaaacggcctcttgtacaccctcaaatctccaaagtacatcatgagggtgttggggaaaggatagttgcggtcagacttgatacccactatggaaatgatatgttacatcacattccccatattgatgaagtaccccaccatgatagaagcaaccaagacggcccggtggagaggaagagtctgatcatgagaggtaggatctaaccggctacacacgaacgtctcccaacccctcgcctcaaagttgagggtcctccgtagaatttttaccccagcagtcaatcaattcggaacggtacctgggattgctaggtaatgatctaaccatggacggacctcctcgcctatctccagcttcgccatatagagggactcatctacttcagtgaaacacaaatagtcattaagcgacttctcatcgaacaacacatttttgttccgaaccttggtcactttgaagcccttgacgatgtgggatacattatagtattactttttgaccaagtgttcattggcatgtacacagtcatctaagaagtgctcccaatcgactcgagtccctaactctctcttcacattggggttgtggggtagaaggtctctgtctataaagctcctctccagaattagttttctcaccagccatcactccctaagcttatggtacgccacctggctaacaaatctatcctcccacactctgggtttcctagttagggcaacccccccccaacctgagtctcaccacactcttgtatctcctcatccccgtgtacctcctcctcacctccgtctgcactctccccgaataatgaagctgtggagaaggtggagtactcaccattaccggctgctgagccctctgacgacttagtgcgaacagctatggtgattgggcagtgggtgatggtggagaagtgtcgtttgtcaatctgaaacttgagacgatatgagttggcaccgagtctaaggagatgtctttggatggtacatactcactcctcgacttatcacaggctctgtcagctaccttaattgcttttctcatcttctttatattttgacgagcctaggaagtgagtttaaccaatctctgattccctccccgggaggaatcacctctctcgggttgtttttatcccttgcatctttgtttaaccattatctgcaaccactgtcaaataacatggttagtatcagtagaaatagtgagcaaaaactatgaagaaagaaatgcagaaagaattgaaatgttgcagacaggttgcagaaacagtccagtgtggaccacacaaaatggagtgcgtctgcacatggaccattacggaccgcacaaaaatgattgtggtccgtagaggagtgggactcagaatacccaccctctgaaactgactagtgcgaattgcacagaatggtaccgcggccgcactgggccagtgcggaccgcacaaaatgtagtgcggccgcactgggccagtgcggaccgcacaaaatgtagtgcggccgcactgggcaaaggtcatttatttagaagttcatcactgtagtccgcacaaaatgtactgcggaccgcactagggcaccgcggaccgtacaaacacgactgcggtccgcggagggtgcccagatatggcactgagttagggtttaagatttttacttatcactcccaattcgtccctaacttatgttcctacatgttaacctagtttattgcactaactaagtagctaagaaacaaaaatctaactaccttaacctatcaaattaaggaattacgggagaaggaagaaataaaggccaagaaaaaatgaaaattaaatatgtaaaggaaagattaatgtaaaagattatggtgtgaattgaatcaaacgagtttaattaagaagttacgtgcaagtgagaagatgaacagtaatttggtactctgagtttcaaattcgcgaaaagggtaaaaggggtccctggggtctatttatagaaaagcccctggggaccattctcacctaccattgcggccgcacaaaatggaccccggttggcactgggctattcaaatcaaacctgataaagcaggcctctgcggtcctcataaaattaatcgcgaccgcagagctccaccaaggaccgcacaaaatataatgcggccccagtggaaaacttcagagaatcctctacttagactttaccagtgcggagcacacaaagtgtagtgcggagcacacaaagtgtagtgcggagcacacaaagtgtagtgcggccacacgagcaacttcatagactgaacattttcttcacaatgttttgcattgcatcaacataatccatgcaacatctcataaccaattagcccaaaaatcaatcctatactaaaaagaaaatcaaagaaaaaaaggaagaaaaagacatgggttgcctcttaataagcgcctgatttaacgtcgcggcacgatgcatgttaccaccatatcacttgagatgaatgagcgctaccacgtggttgtcaacgaactttccaagataatgcttgacccggtgcccattaactctgaaaatttcaccattttttatctttagatcaagagcaccaaaatgggtcacaaacacaacttcaaacggcccactctactttgatttaagctttcccagaaacagacgtaaccgggaattaaacaaaagaaccaaatcaccaactttgaactcctttacatgagcatatttgtcatgaaggtacttcatattatccttatataaggacgagctggagtaggcctggaatctaaactcatcaagctcattgagttgttcaacacgaagattggatgcaacatcccattccaaatttaacttcctgaaagcccacataactttgtgctctaactcgaccggaagatggcaagctttcccaaacagcaaccgatatggagacataccaattggtgtcttgtaagtcgtctgataagcccatagagcgtcatccaacttcttcgaccaatcgttcctattagcattgaccgtctttgaagagatactcttgatttccctgttggagacttccacttgaccaccagcttgaggatgataggggtaaaaaccttatgattgacaccgttgttgatacccaatttttcctatatatttttgtacctaaaatacttccaaaatagcatatatgtgcatatataagcaacccaagagttttggcatttttaataatttttaaaccaaattattgcttattctataccataaaatccaataattatttcctaaaatatcatttttggtgaataacttattgtattctcatatttataccaaaacatagctaacatgattttttcatatttttacaaatttatttattatttttaaaactaaattgcatgtaattgcaatattatcctcttttaagatttaattgtatttatatttataaaattgactccaatatttttaatttgataattatgtattttaatcattttagcacatttgatttatttcaagaaattattttactattttttataaattaaacaagggagaagtggctatttaaatgttagcccttttgaatttcaattttagccagaattaaacccaatctcagccccaaattgaacccaatttcctaattaacccgacccagcacccaattacccgaaccggcccgtgtccccctttaatctgagtcattgatcattttgatcaacggcccaggtttccccttaccatttttaatcctaaacgacccccaaaccctccccattctctcaaactcgccgcctctggttcctctcatctctctcaaatactctaaaacaccctcacaaaccctaatcgccgcctaccttttcgacttcaaatccaccagagtctatggcttctctagccatgaatgacttacaatcacctcacactgctctcacacgcctgtttcctgaagattcgaggccaatcctcgaggatctttacccaaactttggtcgattcaagattttgaggcgtttccggccttgctccggcgtatcgtagcctactgagcctagttctgaccttatcgactcagatctgatctcatgacttccaatcctttctcgtcctttaggtttgtcagaaaccctagcctattcgaggttccttctcacttatttgtttagatctgtgctagatctatgctgtgtgtgacattttagtgcctttccccaaattcctttttcaaaattgttcaaatcaattttagggtttctgaaaatggctcctaaatgcgtctgacttttttttactctctcttatgtgcgtttatgctcgtttgtttcatttcttattatgttcaagtctgttctcttgtttcttacctaatttctagagaaaactcttttctattctttgttcacatgctaacctaggtttgattttcactctttgctatatgtgtttaaattcatgctttgattttgtttctaagttccattgatcattttctttcctacctttgtcttaaaactcatagtttctcttgtttctgttcgtgtatgtctgcctatctctgtgactttgaacgatcttctcatctttgattccatgtgaaaccctaaaatttggggggggggggggtttctttgagtagatggcactagggtttcactctgaaaccctaggtttacagactcatgacgagcttgtaatcaaactcaaaaccttatttgcctatgactctgaaattttcattgtgagactcttctttggtttgaaccgtatgctttatatatgagaaaacttccctttcaaaagcatttcaccaaggcttgattttgataaatcccgttaaccatgcttgtgattcaccactgatttcttttgattgaatctctttttccctaatgatgttttttccttaaatacatggtcttgtgtatctcctttgtgattctgtaccaatgtttgatttatttccatattaatatgactctgtctttaattattaggtcctttgtgattacaattggtccgggaccccttttgattgattttcaaactaataccttatttttacggtactattccatctttccgtaattatcaactatgtatttgacctttatttgtgcactatatggcttccttgccttaatcagcctcattaaacttatcttttttccttatactatcttgactagccgtttgaactagacctcttaattaaaggagtctggttattttaattggtactaattgattagtttctatgtttgtgcactctttgcctaccttacttattttcaaaaactatataaagggcttagacctcccattttctatgaccagtctagaacaagtattctctcataatcacaaacacacataccagtcttggatactacttctcttttctttctcaaatacctttaagttttttcaaagctttcgagtgttctgctgaagtcttgagttgatttcttctctgtgttgtggctgcaagtgctctatttctctctttctgtttactttgcaactggtatgtctagcctatctaaatattttccctctcttatgtgctctgttgtgcttcttccttactgcttttctgcaagtttatcatctttgttatgtgaatccttaatccccaccccctttatgtgtgagttatggttcaaagcatgacaacacttaaatattgttatccatgtgtctggactggattctctgaatccaaatctcaatcaattcccattccctttcccctttatgtgtgtttgagctttagacttgggtctggcagtgtcctaatcacggtccagaccctggtctaaccttcaaagggtctgctcctaatttatttgaccaaacaagtgttcaggggtgttccagcctattttgtggctaggcatgaccaccacctgtcatggttcccctatccccctttcacactttcacttactcttagctattaagttctgcccctctcttgcaagccatgatttgggacccttgagctccctctgaacttggatgcctgagagttggctcttccacactgcactattctattctaatgatatcaggggtgtaagcaatgccgggaatccatgagattccttggaactttgaaacaccttagataaagagaagtctttggaaatctggatcccgaaaatggttcaatcacatgttattagacattaaggtttaggttgctcggatctagcttttagcttctgatgtatcttcttactcttttcattttttctggtttgtaataacttgtataaactcggggaatatagtgaaatgggtgcgggatctttactttcttgcattaaaagggtagaaatcatgaccttaggactattatttaatcacctaaaaattctgcctatagggttgtttactgttaacttaatcacatagaaatcatgcctataggacctagcgctcactttctgcagttatgcatatagaaatcctgcctataggagttagttttatgcaatcttatatgcagatattatgcctataggatatgcatactcatgacgctaggccaattttaggattaattaagcaagcatctgttcacaagttcattaacaagttctgaaatcaataacttgtagatatcatgcctataagagcttcttttaaatcaaactcgcctcgcctgtttaaaagcagtaacaatcgattaacaggttcttatacgcccaggtcggtatatgtttttccaaaacgtaatcctttgataaacactttcaaatcagtgtatccttttccaaaaatctattcctttaacttgcatatcttttctgaaactattttttagaataatctgacaaacaaaatgtgttttccaactcactccccttcttttgaatttgtcattttaaaccagttctgcaatttgcttattttccttaaacgatccacctcttttgtaatctctgaaactactctttctgagcttaattataactgggcagtccgccttttcttttactcacttctaaacatttttcctaagtctgcagcatacattttccttcaaaactcttctgcatagttattttataaaatcagtacttcataaatcaattcacgctaatccagtgccttaatctctgacaactgtatccgagtgcgcttaatgctgactttctgtccaaatatatgtgttgaacaagtcccctcaccgcttaattttaatctaagaccaaatcagtatttgtcaaggcatgctaaactatttgattgtctgacttcaggcgtttatttgagccttatttacttgtttgttcttccctttattcgatacttgttttgaatgtcgaactagaattttatcctttaaactccataaagcccccgatccctttcttcccttttaggattagaagtcctaataccccgggactaataggattgggacgggtactagcatgcaataagtaaacgagactaatcgcgctttaataccttaacggggtgggaagggtagaatatggatatgatgaccggtgcgctaatatcacgtgcgacccctcttctgaggagtgtgcgccgggtattgcattgatgtgacccatattatgtataaacttaggaccctttttccctttacttataatgttttcttttaatcttgtttcttttaactaactttctaaaatctctcgttttcttcttctctttaaaactttgaacttgtttgcaattattatgtaaaaaccttatttttttcttctaccttctaaagtcacaattatagtatggccgagaaccatactagtggatcttgaggggtgcctaacaccttcccctcaagataatctcaagcccttacccaaactctggttcttcttctcaaattcttttcctttaaaagtgtcctaatgcactataatcattaggtggtgactctccaaaaattccaaaacccaattctcgcaagggaagaagagttgtcctctcataatgttgtatacccgattctagacttctgtccacgtggaaaaaaagggggcgtcaacaacatggcgactctgctggggaattctttaggctttttaccattacatgctatttgtgactttattatttcattaattgcctttatatcttgtctttttattatttcatcatgaaaactaacttggttcttcatgtcttttctttcctttaactgctttcctttactgctttattatttcaatcccattttaatgtcgagcatttattgtaatcatttatcttatgtatgtgaaaatacatgtcaatttgtttcattcttgtaaattgcatcttcaacatcatactccactcgtgccaaaacaaatactatagcaacgcttataataagtggttgcgctcttccgatattatctccccctaaatttggcaaaggattatttgtggtaaaacaagtcgatcaacggtgtagtcgacggttccgcgctttttcctcttgagttgtccgctcaagggtaccagtctagcacttcaaatagaaaccttattctgttaaattgtacatgcatcatggtcaaacctagccgagtcagttatgttgtccgcataatgactcattaagatagcctagtccaaagtccatcgggtttcccttgaaaacccaaacggacacgtctatgttctatgcatttatttggagaactaaatacctatcatgctaattgttgatttaaatagtcaagtctggtggagtaagggtctaacgctttgttttgtagaaaataaggcacgaagtccccagattcggtatggtaaccaacattcacccaaggctgctaagctggtgggaggaccttcatgccagtgatcggactgttgtccgcaaatacttaggaaatttaccttcactactggaaatccagcttgacaacaaaatcatagaggctgcaactttgttctgggatattgatcggtcattgtttcgcttcggggaccttgaaatgacccatttacttgaagaaatagggggtctaactggtattccttgggagactccgggtctgcttatgttggaaaatcgcaaaggtagaggcttcctcaaaatgatgggattcaagaaaaaccgaaacttgacttgtctaaaagactcctacataccatttgactacttgtacgagaggtatagccatagcaagtcatactgcacctacaccgacgaatttgcccttacctctttagggcatatccacagaagggttttcgtcttcatgttctattttcaggggatgataatctttcctatgaagaaggctaggatccacaccagactagccatggtaaccaagaccttaattgaagggatcggcagacagtctttcagcatagtacccatgattattatcgagatatatcgagccctagaaaagtgtcagcaagaggccaaacacttcgaaggttgtaatctgttgcttcaactctggcttatagaacaccttcagaaaggtgattaccggcaggaaattatacgcagagattgggatgaacatatcgcttttcaccacccaaagcgaatgaacttcatgcctaacatgttcgcccaaccagaggatgctaaagaatggttagagctatttgacaatctaaaggaagatcaagtgtagtggatgttcgagtggttcccgacaggaggaagaaagcaaatcataccaagggtggacaagatgagtcacttcagggctgattttcaagacaatgacagccctcacaagtgttaaactcagcacatgaggcaaataggtatcacgtctggtgtgtgccgcactactcaggttggttggaagataatcacactggtttgggtcatcctaggtccatccgaggtcacaagcttatcgacgaaaaggctgaagcaaaagttaagtacaatcaattgcgcaaaagaattcgggaatgtaaaaataaacatcgggagatacaggaagctcatcagaagttgatcgacgaatggaaggatatggttgtcaacgccaacaagcggctagggtatttggaatggggtctagtagagctagaagggaaattcttgaaaaggattgaagactgccaaaatgctaagggaaatgcaggtggacatctggcccaagcctatttgctgctaggactacgcgagttggtacagctgtacgagggaggcaagaataccaaatctggggaaggttcttctgggaccaagtagttaggatcttttatttcctgctttcataatgtaataaggccactggccattagtgatattttcatttcccgttatttaatttttttaagactcgtcttatttttatcaataaaatgaggcatttagcattataagttctccaaagttaatttgtcgctaggcctacctcgacacaacgaggcacccaaattaggacgcgacttatattcttgcacaatgtgtttaaatatcacaatattctctttctcaaaatctgcactaacttcttaccttttgtttttcttttatttttattcccctctccaaaggttagttcgtgtattctagcaccatcagcatactctacaagatccaagggccctccacctccacctcctccccctccgagtcctatcagaaataagaacaaaggaagaatgggagacgcaagtgctataaaggtgattaaaagggaggaaacttctcagggtaccccaattgctaagggaactgctgctcatcttgaacaaaaattgctgaaattctaggaagaattggaccaagttcggaacttggaaagcctaccattctcccttgatgctcctaatgttaacgcccagaaccttgtacctccgcaaaacaccccacaaccacaaatacaacccactcacactcaaacctgctacatatgcaataacactccactactcattcccgaaccgccaaacactacaaacaaccacctccacaacactcctatctttgttgacactataccctactatacccaaccgatctcaagtgcaggcgacaatgactcctttatcaggaatttggccgcggaactcaagaagttaactagctgggtccagggtgtcgaaggtagcaaaggcattgaggggctgaactatgaagatctttgcattcagccggacgtcaaactcccggaggggtacaaacctgccaagttcgagatgttcgatggtacatgtgatcccagggtccatctaaggacatactgtgataagctggtaggagttagacgagatgagaaaatacgcatgaagctgtttatgaggagtctgaaaggtgatgccttgtcttggtacatcagccaggattcaaagaaatggacaagcaggtaagtatggcgtccgactttatggaccgattcaagtttaatacagagaatgcaccagatgtgttttatatccaaaatctaaagaagaaacccacagaaacattccacgagtatgctactcgttggaggtcagaagctgctaaggtcagaccggccttaaaagaagagcaaatgaacagattttttgtccgggcttaggatccacaatactacaaaagattaatgttgatagaagaccagaagttctccgacatcatcaagttaggggaaagaattgaagagggcattaaaaatggtatggtcactaatcttgaagcattacaggccaccaacaaggctttacagtctggtggcacatcaaagaagaaggatgttaactccataatggctgcgcagagaaccaaatccccaatgaaataccaaacataccctctaactccactcacatatcagccttccttgaattaccaagcaccctcacccacataccaaattccaccacccacctaccagttatctccacctcctacatatcaacccacttcaccaagatattccaaacccgcacccgggtaccaagattacaatgcccaactttctcactatcaatcaccacccgctcaccaaaactttcctcgacccagaccaaacttcgatagtagaccgcccagacaatatacagccatcgccaaactgattgaccagctatatgaaagactcaaagcagtcgattacgttactcctatcccagccataactccagagaatccctcccaatagatcaattcgaacaaaacttgtgcataccattctggaatgaaaggccataccatcgacaagtgttgctcgttgaacgacaagattcacaccttgattgataataaagtcatcatagcaaaagatcctgcttccaatgtccgcaacaatcctctgcctgaccataagggtgggggcaatcacatgatcgagattgaggatgattgggaccccaaaaggccaattggattgattgctgaaggagatgaaccaaagaagctgacagtcaccctcaaccctattgttctccagatctagccctctgaaggcaatgaggtgaatatgtctataccgctcgagttcgaagcgcctccttcaaaggcacctggatcgattgaggtcgagttcggaattccaaagacacctgcaccatttgaagttgttgtgtttcctccaagggtgcctatttcggttacaatgatagatgtgaccctgttcaactcaaacgtcataccatgggattacactgctgaagctaggagaaaagggaaaaccaaaaccggagaagcaatcgacgtacaaggtatgaccagaacgggcagggtgtatactccagaacacttagctgagtccgatagacaagcctttggatagcctattgaaactgggcccgatgatctttggagaaagatacaagctaaaaaatactcgatcgttgagcaattgaacaaaacactggtgcagatctccatcctggctcttctgtaaagctctgatgcacacaaaaatgctctaatgaaaatattgagggaagccaatgttcccagcaacataactgggggcgagatggtaaatatggtgggacaagtgttggagagtcacaagattactttccacgaggatgagctaccatcggaaggactaagtcacaacaaggtgttgcacatcaccgtgcaatacgaggattacttcatcactagaatcttggtcgatgggggatccagccttaacatctgtccactggtaactttcaggacattggggaaaagtttgcacgagatcaaagatggggctctcagtgttaaagccttcaatgggtcccaaagatccactattggggaaatcagcctgtgcctgcaaatgggaccaacctagttcgatattgattttcaagtgatagacatcccagcatcatacaacttgttgttaggacgaccctggatccatgctgctggcattgtggcatcaaccctgcatcaagcggtgaagttcgaatggaatcaccaagtggtgatcattcatggcgatagtagcaaccccatatacagtcgccagaccatcccaattattggaggcagaaggagaataggcggagaaacataccaccagtcaacactgtggacaaagataaatggtgggataacaagatcgagagcatcctgaactggtgcgggtatgagcccggaaagggacttgggaaaaatctccagggtattaccgagcccatcaagctgaagaaacatggtactacttttggcctggggtatgagtatacatggaaggagtttgatgattggtcgccaccatggcgcagcccacactatccactggagcaccttatacctcggttggagcagactttctagctagctgacatcatatatggatcaaaggaggatgaggcattggcaacaatgaagaacctgtttttggaagatgataaggattgttgtgttatcttcgaggaggaaggggaggaaggcccttccatacaagctgtgaattgaggagaacgcctcactaattggtctatcaggaccaccaggacccggaaagcttcggggtagcaaggtaaataacgcaccaacttctgatatgagatacgtggcgtaggaacagaaatagtgcctcaacttctgagctacccaagtcaaagcacaacaggtgtgctctaacaaagaataccaggtctcgtacggggtgaacttcttgctgagatagtagatggccggctccttgctcctcattgaatcgtgttgccccagaacacaacgctccatccaatactgcaaggtagagtaatatggatcctggctcgggtgggaccaaaactggtggtgttgacatgtacgccttgattctatcgaaggccttttggcagtcgtcagtccatttagtggcggcgtccttcttcaacatcttaaagattggctcgcagataactgtagattgagctatgaaccggctgatgtatttgagtcttccgaagaaactcattatgtcctttttgttcttcggcagtggcacaatattggctaaccatgtcgaatattctactaccctgagaaccttagctttgactagcttagtgacttctttcttgattttcaagctcatgtcaacttgaactttctgagcttttgcttcaccggcgggcatgttagatcagttggcaatttgtgagccacaatagatgtactcagaccagttatatcaccatatgaccaggcgaatatgccctcatattcctttataaattctgtgtattctttcttttctgacggtgacaaatgaatgttgattcgcgtttctttcacattttctgcatctcccaagttaacaacctcagtctcgtctaggttggacttaggtctattatcaaaattctcaatccctttaaccatctcttccggtatgtcatcttcctctgaatctatattcgtttgttgtgttgtctcattgcatgtcatagtcatcggttcatcaagaaaagtaatagtaacgctgtataaataaaataatgagagaaataataagagtaagatttgtaaggaaaatcgaaatgctttgataaatttcataactattttgaacattggagatcttattgcgaaatgtaaaaatgcgaatggaaagtaaactagtgaaaataaaagataatgcatggtgctatgttcagccttgctacctcgaggctttccaggctctattggttctgatggtccaattgttgaggcatgctcctcggcttacggcctatatggaaggccttcccccatcctcgaaaatgacacaacaatccatgtcattatctactagaaacaaattcctcactgctgccagtgcttcttcttctttcgacccatagataacatcggctggcaggaaagtctgctccaaatatggtatcggctgctccagtgggtagtaaggaccgttccatagtggcgaccagctgttgaattcctcccaagtatactcatatcccagcccgaatgtggtgctatttttcttcagtttgataggcttggcgattccttggagattcttgccaagtcccttgccaggttcatgtccgctccagttcaatatgctttcaattttgttgtcccaccatttgtctttgtcaatggcattaactctctcgatgtggtggtaggtttccccatatatcttcattcttcttccgattgctgggatggtttggcgactgtatatgggattgctactgtcgtcgtgaatgatcacctcttggtgattccactcaaacttcactatagtgtggatgctacagccccatcggtatgaatccacgatcgtcccaatagaaaattataagatgtcggcatgtctattacttggaactcaacatcgaaccaagtagggcccattttcaaacacaaactaatttcccaatagtggacctttgggatcgaagtctttgacatttatggccccatcgttgatctcatgcagcccctttcccaatgtcctgagtgttaccaatggacaaatattaaggctggaccctccatcaatcaggattctagtgataaaatattcttcacattgcacggtgatgtgcaacaccttgttgtgactcaacccttctggtggtagctcatactgatgaaaagtcatcttgtgactctccaatacctgccctaccatgttttccatctctcctccggtaatgttgctcggtacatatgcctcactcagtacctttagcaaggcattcttatgcaaagctaggatggagatttgtgttggcgttttgttcagctgatcaatgactgagtattcctttgcttgtatctttctccagagatcatcgggcccaattttagtgatggtcggccgaccagaggcctgcttgcttgactcggccaaatgtttcggagtataaatcctatcggttcttgtcatgccttgtgccgcaactgcttccccggacttggctttcccttttcttcttgcctcggctgtgttgtcccaaggtatggaattagtatggaatggcattataaccgacattgctactggaatgggcacttttactccaaacagagcatgtgttttaggaggtaacgcagcaacatcaaatggtacgggtgcatttgctggagacccaaactcgacctcaatcggtgctagcatctttgtagaagagggtacttcaaactcaagtgacatggacatattcacctcggcatccttagaaggctagatctggactacaaccgaattaagggtggctgttggtttctttgtatcgtcgccttctttggtcaatccgatcgatcccttagggtcccagtcatcctctatttcaatcatgtaaacacctccacccttgtggtctggaagagggttgttgcggatattcggagcaggttccttcgccacaataatcttgctatcaatcaaagcctggatcttatctttcagagagcggcattcattaatggtatgccctttcatgccggaatggtatgcacagtatttacttgggttgacccattaagaagggttctcaggggttatagcagtgatgggggtgacataaccagcagctttgagcctttcgcacagctggtcaattggttcaacaatggcggtatattgtttgggaagtcttcggtcaaaatttggtcgaggtctaagaaacttttggcgagcgggaggtgattgatagtgggatggctgagcattgttggcttggtagacatgtgcgggttgggaatatctgggtgaagtaggctggtatgtgggaggtggaggtgattggtaagtaggtggtagagcttggtaagagggtgagggtgctcgataatttggagtaggttgatttgtgagtggaggaatcgggtaggtttggtatttgatagggaacttggttctttgggcaaccatcacggcacccacgtcccttttcatggacgtaccaccaaactgtagagccttattagtagcttgcaaggcttccaagttcataaccataccacgtttgataccttcctcgataatttctcccagcttgatgatgtcaaaaaatttatgattctcgatcagcatcagtctttcatagtattgcgggtaggggtgggcatcagtcggttcggttcggttttaaatcatatcggttattggtttataaatatcacaacccgatagccaaatcgataagatattagttatcggttatcgattatcggttaatcgattattgatcattatcagttcagctaccgacttacccgataagataaaacaactaaaacaattttgcaatatataaaactgtcgagttttcaattatcttaagccagaagtcaagaaatagatcagattttcgttgtctttcacaactttctgatgcataaatataggattacaaggtggaatggaatatatgattgtattgttaataaaacatggtcttgtatccttaagaatagttaaatagaagtttactgcttaggattcgtaatattccaaaaagagaaacacttgttaaaattataagtggataatgcaacaacactaaatttatacatttcttgtcaaagcccatttcatttctcataaaacagaatctccaaaaatgtttaaagactagacaaacgattagaacaagatctcaaataatagcagcgtgcacacacacagtacaaccccgcaaaaaattattaagagccagaatgctttcaaacatactaagaaaaagatgaagatgaagcaactaaaaacttacacgccggcctaagtcttgacaagctgattggtgagggcgtgatgtgactaacgagtgatgccgacctaagtcttgatgggatgattggcgactggtgagggcctgatccgtgaggcggagaattggtgagggcatgagccatggtgaggcggagaactgttgaggttggtccgtaggggtgcgacggaaaaattgagaaactgacttactgagaattgagaaaaaataggaaaaatcaattatgaaaccctagtatggtatgtatatacttaagggtaaactagtaaattagttaattcttattgggttatcgatttttacccaataacataattgcaaataaagcccgaaccaataacccaattaaaaaatttaacccattatcgaatcgttaacctaataacccaataccgataacccaataaataattaacggttcgggttatcggttttacccgatatatgcccaaccctaattgcggatcttgagcccggacaaaaaacttgttcatttgttcttcctctaaagcaggcctgaccttagcagcttctgatctccaatgagtggcatactcacggaatgtttctatgggcttcttctttaaatactgaatgtacaacacatttggtgcatttactgtattgaatctgaatctgtccatgaagtcggacgccatgctcacccagttagaccacttcttcgagtcttggctaatgaaccaagacagagcatctcccttcagactcctcatgaaaagtttcatacagatctttttgtcctttcctactccgaccagcttgtcgcagtatgttctcaaataaactctcggatcccctgtactatgaaacatctcgacctaaggaggtttgtaccctttgggcatttcgacatccggttgtatgcaaaggtcttcgtaattcaaaccttcaatccccttacttccatcgacaccctgaattcggctagtcagtttcttgagttcttcagccagattcctgataagtaagtctttatcatccgactcgggtgtgattgaaatgggttgagtggagtgtggcatagtttcaacatatatgggggtgttatgatgagggtagaaatggtcatttgtggagttcaaaggttccgggatgagcagtggagtattgttggatatgtggcaagtattgcagtggtggtgaggagtgggatggttctgtggttttggaatgttttgtggagttttggggttctgagtgtttggaaaactgacatctggggtggtgagggaaaatgacaagcttgccaagttccgaacttgatccagttcctcctgaagtttcaacagtttctgcttgagttgggatgcacttcccttggagacatgagcaccatgagcaacctctacccattcagttgatttttcctttctatgttgagcaaatctttcatttttcctttgttcctgtttctggtaggattggaggaggagtggatggagggcccttggatcatgtggagtaggatgatgatgccagagtgcacaaactaatctttggggaggggaataaaacaaaaactaaaaacaaaaggtaacaagtcattgaggattatgagaataaatgttgtgatatttaaacacatagtgcaagaacataaattgtgtcctaatttgggggacctctttgtgcctgaggtaggtctagcgacaagttgatttggagaacttataatgctaaatgcctcattttattgataaaaagtagacgaatcccaaaacgatacaaaataacaggaaataaaatgtcactaatggtcattggccttattacatttcttaaagagaaagaaaagactcctatctatttggtcccagaaggaccttccccagactcagcatctttggctccatcgaacaacttaaccagctcgcgaagtcccaacagcaagtaggctctagccaggtgtccactttcgtttccctcagcattctggctgtcctcgatcctcttgatgaatttcctttccagctccactaatccccgatacaagtatcccaatcgcttgttggcactgacggccatgtctttctacttttcaatcagcttttggtgggcttcttgtatctcacgatgctcactttcatattctcgaatcctcttgcgcagttggttgtatttgatatgtgcttcagcattgtcgtcgattatcttgtgacctcgaacaaatcggggttgaccaagaccattatgattatcctccagccagcttggatagtataaagtataaccagtatggtatctatctagctcaatagtgtcctttcccatgacaattttgcagtgccacatatgctgagcttgacacttattagggctatcatcatcctgaaagtcggcccggaagtgcctcatcttgtcgaccctcggtataaccttcttcctacctgcctgtcttataactcggagagggatgtaagggtaagttcctcttaaactgataagtatcataaacggcgcatccctagatcgggcaatgaactcttcggtagggaaccactcaaacatccattgtacttggtcctctttctgattttcgaacaaccctacccatcatttggcatcttccgactgagcaaatatgtcgggcatgtagttcattcgccttgtctgatggaaggcaatatgatcatctcagtccctacactgaatctcctgtcgatattcacatttttggaggtgctccatgagctagagttttagtagcaagttgcaaccctcgaagcgtttggctcctcgttgacagttttccaaggctcggtacatttctgcaatgatcatgggcactatgctaaggttttagtgactatagctagcctggtatggaaccttgccttcttcataggaaacactatcatccccaagaagcagaacataaagacaaagacccttcggtagatatgccccaatgatttgagggcaaactcatcagtataagtatggtaagattttttgtgaccatacctctcgtacaaataatcaaagggaatatatgactctttcaaataggccgagtttggatttttcttgagacccatcattttaagaaaacccctacctttgcaattttccggcattaacaaacccggagtctcccatggtataccaaccagtcctcctatttcttctagcaaaggtgccatttcaatgtccccaaagcggaacacagacttatcaccatcccagaatagagtagcagcttcaatgattttgttgttgggttggatttccaaaagagaaggtagatttcctaggtattttcggacaagagtctaatcactagaatgaatatctttccaccagcttaacaattttgggtggatgttggtgaccatgccgaatatggggacttcgtgcctcatatttctacaaaacaaaggtgttaggcccttatcctaccagactcggctattaaatatcaacaattggcataaaaatatttagttctccaaataaatgaacaaaatgtggtagtgtccgtttgggtttcaaggaaacccagtggactttggacaaggctatcttaaagagtcattatgtggacaacataactgactcggctaggtttgaccatgatgcatgcacaattgaacggagtaaggttgctatgggattttagaccgatacccttgagtggaaaactcaagaggaaaaggcgcggaaccgtcaactacaccattgatctactggttttaccgcaaatattcctttgccggatttaggggagataatatcggagaggcgcaaccaatcattataaggttgctatggtattttgtttggcacgagtggaatatgatgttgaaaacatttatatgcaataattaaaacaagttgtcacgtatttgcacgttataaaagtaataattacaacatttcatcataatttacaacaatattaaaggagagcggtaaaggaaagcgttaaaagaaattaatgaaagaaacaaagagccaagtcagtttcgtagtagaagaaggaattaaatgcttaaaggcattaaataaagacatataaagaagcgtaaaatcaaaaatagtatgaaatggtaaaagcctaaaagatatccccagcagagtcgacatgctgtcgcgccccctttttctcacgaaattgggtttctgacatttgggaggacaatttgtttccttttgaaaattgggtttggaattgaagagtagccacctaatgcttaaagtgcactaggacactaagaagaatttgatttaggaaaccagagattgggtaagggcttgaaattatcccaaggggaaggtgttaggcacccctcaggatccactagtatggttcccggccaggctatggttgtgagtttaagtgcaaataacatgtaggcaagtaaggctttcaaataaagggggattttcatagaatggttgcaaataattggagttaaaataaacaaacaaaaaactaaattttgagaaaatagtttgaaatttgaaagcaaacaatgaaatgaacaagaaaagggaaaggggggtcctaggtttataaataatatggatcaccccacacaatatccggtaatcactcctcaatgagggactacacgagatgttatcgagtggtcatcatatccatatctaccctttcccaccccggtaaggtagtacaatacggaatggtctcgtttacttattgcatgctattaccctccccaatcctatcagtcccggaggtatttggaactactaatcctaaaagggaaggggtgtgattttttatagttttaaaaggcaaaaattctaaggcggcaatcaaaaaacatataacaagtttgggaaagacacatacacaactaaggctcaaacatacctccttaaaaaccaagaaaagcacatagtttagcatgtcgtgcacgtactgtttagggtctgattaaacttaaaagttaaagcggactgatttaatttatcacatattttcaaataagatgtctgaattatgcttgtccggtggttgtaattaataaagactgttgcagtttataacttttaccctaaggcttgcctaagcattagacgaaaacctatcggcatgatatctactgatttcataaacgaagaggtaaactgattacagaaaagttgccagttttaatagaatagtacaagttcttcaattgataatacattactactgatatttttaaacttacaaacgggtgaggtgattcatatttgattacaacccctataagcatgctttctacgtgtttgttaactttaaacactgttatagcactcattgaaaaaccaccaccatcattatcatattgttcattattcccttgagattgttgccctctttgcctccttttaagcatagagacaccttctgtggcattgacttgacgtggattttagacttgttgcaactgcaccttcaccaattggttcatagtagtagtaagctcgaaaatagcttgactatgatcatgcaattacttgtgcaaatggatgactatggggtcaccttggggcacattcgctctactttgccatgttgaagaagtgtcgttcatctcatcaagtacatcacatgcctcgttacaagtaagcttcataaaattgcccccggccaattggttcacaatacattaatttgtggtgtttatgccctgataaaaggtttgttgaatcatcgcctcggtcatattgttattcgggcactctttcaccatagtccgataccgctcccatatttcatgtaaaggttctgttggctcttgcttgaaggctaatattttatcccgaagtgccgccatatgactcggtgacaagaatttggcaataaatttatccgccaactcatcccacattataatggaatggttggggagtctctcgagccaatcttgtgcctttccccgaagtgagaacgggaaaagtctcaatcttagcgcatctcggatacattcatctgctttttcccccggcatgtatctacgaacccctttagatatttataggcattttgatctgcagcacccgtaaagtacccatgttgctcaagtaaggtcaacatcacattggttatctgaaagttgcccgcccggattcagggtgggacaattgcacttgcgtagccctggttcggtaatactttgtgagccactcttggaggtggcgggggagtgtctggaatattatcatttggattggcattggcattttggcctctccgttgtccttgaggtgcaagaggcagctcatcttgctcaagatcttctccctgctcccccggtatcacatttccaggagggtcattcgcgttgtttaaagccatgttggtacctgagtaatgacacaaacaagtaagtaacaaagaaggaaagaagaactttacacaaaactaactggatagatatccaaagtcattagctccccagcaacggcaccaaaacgtgatcgctacctacttcgcactactataaagtaggaagagagggtcagaatagcttttacccaatttgtgggtcgggatcgaattccacagagaactaggattggatttgggtgtctattcagttttggattgcgtattggttccaaatatcacttccaattattttttgtttttctatataaaacaactattatcaaactacaaattaagattaaaactagattatgctaagattagattgttacaagttgtatctaatggattaaggggcactagggtagttacttttcaactaggtggccaattgaccggtaattgcttctaagaattgattgacatgattgggaaaatatgctataaccatttcacgactatacccactctcacacctctcggtatagagagtgatttttcccaattaactctctcaagaccaaatgggtaggcaaatttgctcaatcaactagggttcaagtcgggtaattactctctcgaggtttaaccctttaattgggactatcaattctcttaagtccatcctaatttcttgttgggtcaatttttgagacttaggctctctctctctctctctctctctctctctctctctctctctctctctctctctctctcaagaagagccaagtcaacttagcacaaaccagtatttgcaatcaccaattcataaattaaactataaaattgacccaaataacaaacatccacagtcaatctagccctaaatcacaacacccatcaattacctacactagggttgaaccacaaccctagctgatgggtctagctactcatgcttgaagataaaaatagaaaaatagatgaagaagaagacatattaattaaataccaaagtaaatatagagattctatcattcaatcaaagttaaaatgcccaaaatggatacaaaatggcttctcaggagcgcagctgaagttctatattatcttatatcctaaaaatggaaaaaggttctatttatactaagcaggaaaaactggataaaaatgcccctgcggggtcagtgcgggccacacaaaatgaactgcggccgcactaggctcttgactcttcaaattcacttctctgaactcaggctccgcggactgcgctgaatggatcgcggccgtggaggcttctaatgcagtacgcacaaacatgaccacggatcgcgttggcttgaaccttggcaatttacatctctctgatcttcgcctctacaaactgcacataatgttagtgcggccgcggggccttcagtacggaccgcacaatctccactacggccacactactttgacacttgatttgtcagttttttgaatctccatagtgcggaccgcacaaagtgtagtgcggcccctgtttgtcctgaatttgccttgtctttggtacttgtgcaggttttactccttttgagccaatctttgacatctcgtcactttgtcgatcaaaccttcaatcaagcacaacttatgagccttttgggactattttataagaatttattatcaaagcgtaagaaagaaggagtatgaaatacatcaaaatccctagttatcaatgtcgtgccatgatttgagagataatgcacgaagggtgatgttgcaccgattctgttgtttcttatggtgaggatgagagcaaaatcatgaagggtgatgtcctgcacgtgttagtgtttcattattcttgttgatacaaatatggtgttcattatgcttctctatttaattactattacaacttgatattccctgcatcatgtccccattcccgtctttatctgtttattcatgttattattgatttgttcgtatatgattcaactgcatagtttataagattgtcgtgtcctagcctcgtcactactttgccgaggttaggatcgacacttaccagtacatggggtcggttgtactaatactgcactctatactttctgtgtagattttgatgctggacctcatgagtagatcgtgggttgcttccttcagtacaggagacccgaggtagatctgtcggtgctcgcagactccgtagttcccttccttatgttatagatatactgtctcttttcatttcaagaacagttgtagttcctttaaacaaatttttgtcggaatctttggatgttcgtgatattgtgacacgagatcggcgggaaaccttgtttcagaacttaaggacttatggaacttccgcattttatacctgcttagcttcatttgcaatttattatcgtttgggataataatcaatgtgttagaagtatttgttggcttacctagcttttacgagtaagcgtcatcacgatcctggcggtggggaatccgggtcgtcacaactaacaattgtcacacagacttaccaatcaaacaaaatcagaaagtatttagagttgcaatcaaaagtagaaatcaagttgtactaatcagtcaatgtacattgatatgtaaagaatttgaatgattggcacctgtagaattattttttttttccgcattagcccaattcaattcttgtcacataatgtagccagagtggaaaagttacagcaaaccaccaatgtagaatttggtaaagtagagaagaaaaaagtaacgtgttatgcagtatattgccattaagtcggaatttgtaaaagttaagaaataaaataaaatgtcaaaagctagacaaatgacttaccatgacgtgcgtcttttaccgattaaataaagattagaaaaatacagtgaaagataatagataaataataagttaatgtacattacatttacataaagtactagattcaagtatctgctcttgcagccttagtttggataacaacaacttagaatacgacatcttaatcaagaagcttcatagcggatagtggggaactgaaagtaaaattttattgttctctgaaattattcattcaaagactatacatcgatatatttttacctataattaatactcacaaaattagtacttgactcaatgaataaattgataaataaaatttcaataattaaataagtaataaatatttgtttacttcaagtcactttatgaagagtttaattgcttaccatttagtattaagtgttgatgtgtcatgcaaatgattaagcatttaaatatcaaatgagacgaactctctctagctcgcaccttattctcttcacaagtcaaccacggttaaattaaagaaaaattatacttaacacaattaatgtaagtaattgaagatccaaaggaagctaagactaaagtttggggcaaggggcgaaaagaagacagaggaaacaataaaaagagagttccaacatctatttgttgctttttataaccgagtacatgatcataatttttttttcagttatagctgaatactctattaaaaatgagtaacttcaatatagttacttctacaatctatagcgcattttgaacaatgtagacaaattaaagattcagtcgagatattcaagttgagtattatggaggcatgaattataaaatagtgaaactcctcctatacttgtttcaaatgcagatatcgtcagaatacctgacttcttgatttgtcatccatgagtcactggctacgcaatcacctttgttgatcatatttatcattttacatatttaacatcgaaaaaatatctattcagctaaaatagctgccaaacagacttaacaacacacaaggatatcaaacaattgcagtgcttattatatactttagtaaagaggaaacaaatcagttgtttgatgtgaccttattttctagattttataaagaaagctctaaaccagtaagattgtttatcaaagcatgttgagggagtttttgtccaagtattcatctatatatctcaaaattttaagacagtgcttttaggttttggtgggttttcagagtgtcatcaccttgtgctaactttcattaggctaacatgctacaactttttatttgggtatgggccgagcatttactaattgccactagagtcttaggtttgacttacattgcatttctataaatatttccatctttataacagcttctgaaatttctactatactttagatggagttgtataagcattcaccacatcaaaagtttcagtcatgcaccatgtttagctcaaaagttatagtgcactttataagcataaaaacaattgaaaaatcattcaagggccaatcatagcagatcgtaataaaccaaagaccaaataaaaggaataagaagtagattcattgcattaaggtaagcgaacgaagagtttttattaatttgatattgatttggtctgcccctccttggagaggttcggagccttacaatgaatattctttcttccttagaagtagtggagaagaagaagaagcagccccctttttagggttctttctcttagtatttatagctacgaaccctgccagctggcgctgagttgccgtgaccacattgagaggacgtcctcataaggacgggaaggtcgtagcctcattaatcaaattgggtaattaccagataacattgttaataaatggccagaccatttattaattgcagtaggctttgagaaatgggctggctccgttaatcgtcatggagtcaagttttgacccataaaaataatccctcttcttattgaggtcatgccctggccgagctcgatgagaggacttcgccgactatactttgagaagctcgaaggtgggggtcgagtattgccttggtcgtgactgaggatggctgcagccatttatgtcgtgaagattgttttgttggaatcggcagtcataaccactttgcatgagcggccctagctataatggagtcaatggcgggagatggatccacgtttgatgataatagccgcattccttcgagggttccaactgtttatacactgggatggccgtggtcattcatacatttaagatggccgtaaccgttcatattttgagagatgtccgtagccgttcttattttagagagatggccatagccgttcttatattggagatggtcgtagccgatcttattttggagatggccgtagccgttcttatattggaaatggccgtagccgatcttattttggagatggccgtagccgttcttatattggagatggccgtagccgatcttattttggagatggccgtagccattcttattttttagatggtcgtagccgtttttattttggaaatggccatagccatgtttcgtgtggccgaggaggatacgaccacgcttgacgtgtactgggaagacgtctattgtttggtgatgtatgggatgccctttcagtgatttcggaccgttataaccgttacgaaggcgggtgccgattggcggttgaggagtcgtttcatggtgcctgtcataatgacgtatgttactgtagacttgaaccgttttgcggttggtcaagtagttaatgatggcttttggaattcgtgaaagtcacttgcgtttttcaataaataaggagttgcatcattcgcttcttactttttcgatacttgcttaagtgagatttcaaaaaaaacaactctttttattctcagttcactctcttctctgttcttcattactctttgttgctcttcattgtttttcattcagtcaccaccttcgtttgctttctggtgaatcttgttcgtttcttgtttataaatcagcaatggcgaatagttctcgcactgatctttcttcggcgacccttccagcggctgaaggaccatccatggtggtgaggaccaccgaatcggcggagatcgataggctctcgtcggtaaatgacattctgtccttgctcggaggtccggtgtctgattttgccggtgatgagggagaggaccaggtgaatgaatccccattgatgggggaggtgggcattgccaaattgagagagcagtgggatatcccccgctatgctgatatcatccttgctaggagcgaagagagggtccatgtcgaccacccagggtattgtgttttctatgcttaccctttcaagctagggttcaggcttcctctcccaatgctggtggtggacttctgccgccactaaagggtgtgccatggtcagctcgttccttctttttataaacttttggcgatgctgacgaagtaagcggagttggcccgaagggggaccacactggggcacgtgttgactctctacactccccatagggtccgaggtaccatgattcggttggtcccccgtggggcaagcggcctaactgaggagttagacgacatggctgatgtccgtccttatgaacacttcttctatatcaggaccaagcacttggtggcatatgctactgagttcctagaggcctggaatcatgcacgtaagttcttattttgttggttccaactttttcaattttacatttcgcctcacatttatacgtactgatcctcctcatattcatagctggaggtccaccaccggctctgttgtccgacatccgcgaattgggtcgaggtcgtgctcccttatacagcgggaatccgcacatgggcgtctttctgagaaaaccatagccgtaggcccgctactggtgagaatctgacctgttgtactgtctttgctttgttatacttagtttcttcctttcaactctcttcattcgttgatcagggaggccacgccgtgtaagggctccttagctcgctttctgcagaccgggggtgactgcacggttagttataatgctggcgcctcgttcagttctgagggcgactttggtcgaatcttcagcggctcactccccagcacggtctgtacaggtggtcgaagagtcttcgggggtcgtgcgccctagggcggagttgccttcgaatgaggatgaagaggaaaaggagaggccacaggttcggcgtagggtggcattcacttcggcccttccgatggtgataagtttggactccccaccatcggacgcggaggggaatgtggcggtgcctgctcttgagggggggcatacagtgggggttgccccggttggcttaggccaaggtgacactatcgctttggtgattcaaattacagctccagttgctgagaggggaggtagttcctcagcaactgttttggtgggagaagtaagcgccaatgtgttagcgggggtggaagcctcaacttctaggatggtggaagcctcaacttctagggcggcggaaggaaggggagcctcaggatagagagataattctgagtccgacttagaccccgaagacatccgcatgtttcaatagggttttactaacccagcggtgcaggccgaggggcagtttcactatgttgagattcctactgggcagaacttgcttcttgaggaagaaaacttggtgacgttgttcgaggttatgtgctcggaggcggaaagcacgtctttgtggggtattacggatgtcgggttgatgggcgaagtggccactcttagcataaaggtatgtgtagtaaccttagcttattctttcccttagttgatccttttgttctaagtgttgttttgtcgttgtagtcatttttgttggaggtggagagcatccgccgagccaacgtccgctcagtggcctttctgcgggtgttggagaaataccaccgttatcggggtcggtgctgtgatatatatgagcgcctgagaaacgatcctcggaaccgggaattggtcgaagagttggcaagaagagagcttcaaatgcaacaggtccttagcagggtgaacacccttgaggggaagcttcgtcagaaggacaaagaaatagatgccgagaggagagctgctgctgagagagagtgccagaactgggtaacggtagcagagaccgctgaggctttgaccgggcaggtggttgccttggaggtggaggtcgctgctttgaggcagcaagcaagggatgccttgtcgagggttgaggtactggagacggcaaaccgcgcccacaatagggagcgtgggttggagagggatatggcggcttatcgagagagaacgctagaaggctgcattggtgtttacgaacaggacgctcgaattgcggcggatcggattacggccttggaggccgagaataagcacctaaaggaccaggccgcctctttcggtcctgcttatgatctttggacattcgctgaggcctaactcgatgtgtataaaaggtcgtgggaagccggcgttgtgcctgaagctgcttatgaagaggcccgtcaaaaggctcgtgatgcctgcctctactgtggctttgacccgtctactcctgggtttgatgatggcgccgagggcgctgatgatgttgatggtggcgccgagtgaaagaaaactttgtaatgtttgttttgttccgtattttcttttttaattgttgttaccatttggctattttttttatttgcccgccttggccgggtgtaggcggggttaacccattgtgaactttgtaaatatatgcgactttcttttcccttatctgccttgtgttaatttcgtgtttttttcttttttgtactcgttcaagggggctttgccttagagtttttctagtgagcatgttggtccctatctgactttggtcgtgacaacgttggtggccttggccatgatgacgttgatggccttggcccgttgggcaattttggccattgtcgaatcgatttcttgccttaatcaaaaattagcgtcaatggtcttgaccatgattagacgttttttgcttatcgttttcctttactcggtatgagtaagtcgtagccattatttggcgagggcggcatatatccttagtcccagttcgggcgtggttgaattgttggtcgtggccttgtaattcgaccggggctggactttttgcggcccgaatcttagttcgagttaggcgtacttacttgaatggcgaaggttcttaacttgttccttcgttttttgaggaacaggtcttgctgcgtccgatggtgagggcgcttggcctgagtcttggttcaaacggggttggactcccctatgacttttgggacgagggtgttcagccttgccgaaagtggcgagattgggctcgtgatggcgaaggcgtacgacctgagtcccagttcaacctgtagttgaatttttgggcgagggcacgtagcttgagtcccaattcaactcatagtttggacttttgggcgaaggcacgtagcctgagttgttgttcaaccgtagttgaacctttgcaattttttattggcgaaggcgcatagcctgagttgttgtttaaccgtagttgagcttttgggttaaggcacatatcctgaatcccaattcaactcatagttgaacttttgggcgaaggcatgtagcatgtgtcccagttcagctcatagttgaacttttgggcgagggcacgtagcctgaattgttgttcaaccatagttgaacctttgggcgaaggcacgtatcctgagtcccagatcaactcatagttgaacttttgggcgaaggcacgtagtctgagtcccagttcaactcatagttgaacttttgggcgagggcacgtagcctgagttattgttcaaccgcagttgaacctttggacgaaggcacgtagcctgagtcccagttcaactcatagttgaacttttggaaggcacgtagcctgagtcccagttcaactcatagttgaacttttgggcgagggcaagtagcctgagttgttgttcaaccgtagttgaacctttgcaatttttgatggcgaaggcgcatagcctgagttgttgttcaaccgtagttgaacctttgcaattttttgatggcgaaggcgcatagcctgagttgttgttcaaccgtagttgaacttttgggcaaaggaacgtagcttgagtcctagttcaactcatagttgaacttttgggcgaaggcacgtagcctgagtcccagttcaactcatagttgaacttttgggtgagggcacgtagcctgagttgttgttcaaccgtagttgaacctttgcaattttttaatggcgaaggcgcatagcttgagttgttgttcaaccgtagttgaaactttgcaatttttgatggcgaaggcgcatagcctgagttgttgttcaaccgtaattgaacctttgcaattttttgatggcgaaggcgcgtagcctgagttgttgttcaaccgtagttgaacctttgcaattttttatggcgaaggcgcatagcctgagttgttgttcaaccgtagttgaacctttgcaatttttttatgacgaaggcgcgtagcctgagttgttgttcaaccgtagttgaaccttttcaattttttatggcaaaggcgcatagcctgagttgttgttcaaccatagttgaaactttgcaatttttgatggcgaaggtgcatagcctgagttgttgttcaaccatagttgaacctttgcaattttttgatggcgaaggcgcgtagcctaagttgttgttcaaccgtagttgaacctttgtaattttttatggtgaaggcgcatagcctgagttgttgttcaaccatagttgaacctttgcaatgttttgatggtgaaggcgcgtagcctgagttgttgttcaaccgtagttgaacctttgcaattttttgatggcgaaggcgcatggcctgagttgttggtttaacttatggttgaactttttctccccatgtaacccattgtgcatagggtgttgggggttagctctccagtttgagatcttgcccaatttgtgtgtagtcttctcgaatagtttgtacagattgccctgttatggatctcggttcgggatgctcttgtgccattttagcaagatcctgtatcaggaagatgagggtacctcatacatgctatccccatagggaggggatctacttcttcttcttcctcttgtatttttctcgggagtgagggatccaggttcttgtcgaagcttttgggttcccttcacccgttacgttgcatttgcccattcgagctgggttgtttttaccctttgggtgttctctttcctttttggtccaagaatgaactacgcgattctgctatgaaatccccacagacggcgccaaattgtttagctcaaaagttatagtgcactttataagcataaaaacaattgaaaaatcattcaagggacaatcatagcagatcgtaataaaccaaagactaaataaaagaaataagaagtagattcattgcattaaggtaagcgaacgaagagtttttattaatttgatattgatttggtctgaccctccttggagaggttcagagccttattatgaatgttctttcttccttagaagtagtggagaagaagaagaagcagccccctttttagggttctttctcttagtatttataactacaaaccctgacagctggcgctgagtggccgtgaccacattgagaggacgtcctcataaggacgggcaggccgtagcctcgttaatcaaattgggtaattaccagataacattgttaataaatggccacaccatttattaatcgcaaatagactttgagaaatgggatggctctgttaatcatcatggaatcaagttttgacccatactcaccctttagtattgatcctttaaggtagtagaattaggtagaaacaaaatatctttaaaaaaacaataactacgcaaaaagaagtattgccggataaattagcatcattcaatacatataactgaacttgtacattataaaaataatttcagctaagtaaccattttttcacaacaaaatagagccctatttgctgcttcaagcccctgaatatttttctaacgatctgaggcttcaaaaagattctaaaacacaaattttaactacatgtttaacattgattaatatggatatacaatacgtaaaatgtaaaatgaatttcattggcatatatcacaaacaaaggaacttatgtgaacacacaatatactgtataattacataattaaatttaagagaagaccttaaatgaattgatagtgccaagggaggccagagggtaaagccactaaagcggtggctttacgccaaggaattttaggggccccaatttttgtttcccaattcttatttgatgttcgttatttaaattgtgacattgattaattcaaatttgtatcgtgtaaaagtggaaactgttccttataagggatttttttttgtttcgaaatactgaaaccgaatactttcggttaaagaaggagatatgctatccatctcaccacaactcttctcgtgaggccccaaatattttgaaaaaaaatattatgtatttagaaaagtaaaatattttatataaataaagaattacattaatcattagaaaatatataatacacttttaaactctattttttcctcaggttttcatcattgcaaaaacatggcaataatacaatttgttgtacttctacaaaaaggggatagtttgtcctaaatcctaatgcacatccaaatttaagtaccagtacttccacaaagtttagtgcaagatgaataaatttgtgctcaaagtactgagaaggagcataaattttccaataagaaacatcaactataaattaggaaccgtaagatgacatcaagtagcaaagaagaattatactagaaattctgaaaagaaaatccattaaagtttttctctcgacacattaacatgcattgaaatgaaaatatctagtgtctgatgtgcaaaaatcaagaccttttttagccgatgacagattaaacaaattacaatcttcgaaaaaaaatgaaggccggagattagtgaagagggttaggcagaattttaaccataaaattaaaaaatctaaagagaacggaagaagatttgggcaaaaattaaaagaaaaacataccaaagttagctagatccaattgggaagatgaagaggtaacgaagattgttggaataaaagagtcatctcacatcggttttcttcaaaataaaaaaaattaaaaagtgcttccagagtctagtgtagtcgtctttctcataccgatagaagtagcaattttaatataaatatgaaattattattttaccctcgatcgaccaacttggctcttctataaaatagactagatggttgatgcccgtgctatgcatggcatatgcccgacatcgctgatattacaactacaagattaccaaaagagagaagataatttcttacttgtttcacttgtttagtaggattatcaattaataaaaaaggaagtcctaccatcaaagaaatactatcaagctaattaaatattgacaaacatgtttccatttcatactatgtacaatcatttgattaacaaaattgtagaaaatatgagacatatattataacagtgcattgttcagcttgcttccatgagagtacaatttacataacaataaaaggtgatgcattttccatccggtgattagtcttctcctttctggtgtctgacaaaaatattggcagcagtagaatatgaagaagttatgaaatgtgaagaacaacataacataaggtaccaatttatactacaaataaatgaacaaaactgaggaagaaaaagaataaatcatatgaaaagttaatctgcataaaaaaagaacattaattattgacaaacacaagaaaaagaaaaataagaactgttttagtttatattgcccggacccaggagcaaaaacggatccagaatttagaggctctgggtgccaaaaattttgaacgctatcataatacaatttacatagtctaataggacataaatataatcggttcggtctatttgcgtttcggttcgggttattcgtctttggagttaatataaacaaatcaaacgagctaaaaaattacgtaataattatgataactttgaaaaaaaagcataaaaattcaactggcttatgcattttgtactataaaaaaactcgttatcacttcatgtttagatacttaaggcaaaacttaaactaataagcactctaaatattaagtaaatttacagatatttttcaatttttattttcataaaaattaacgcactcgatattgtatacaattttcctactttagagaaatttgacaaaaaataaactttcatcattgattaaaacaataacttattcaagaatttttattttttttaatttttttgaattcaaataaatttttcagagttgtggtccttaagaaaacaattaatttttctgtatatatgataaatcatggaggagttaggaaagtgcaacaataaaaatttctttgaataaaaatagactaataagatcaaagaaaaagtcaataggacgtattaataaacaacaaagagaaattaagtaaagagaaagaagaacaaaggatcctcctataattgtcttaaatgcaccaaaaacaactttttaaataaggataaatcatggaggagttaggaaagtaaaacaatgaagatttctttgaataaaaatagactaataagatcaaagaaaaagttagtaggacctattaataaacaacaaagagcaattaagtaaagagaaagaagaacaaggatcctcttgtaattgtcttaaatacatcaaaaacaaactttttaaataatgagctaggctagatttgaacccccatcttttgggtgaaaagaagtgccttgctagtggcaccagaagccctttctttttaagggtgccacttaatatacttgtaagaattagttctttatatatatgtatatatattattgcataatttcggccaaaatttacgggtggcgtaccatcccgtcccttacacgtagatccgcccctgcctaggagtatatttttgtcaccaaaggtccaacttaccaaattgttaatacatattcgatgttcccgttcaaaaataaatgagctgacgcaaataaaattaataagaccacaacatataattctgtaaggttgtaatggatgaagacatgaagctttcgaatacaggacaaatcaaggccccaatcatgattaattacagaggcataattcaagaactccttgaaagtttgtattcaacgggaatttcaccttgggcctcccaagttaactattccatggctcgacgcccaaaaagccagaatttgacgaaacgccgataaacaagctaagcccaaaatctttgaaaatttgcttagtcaccaaaaaattttatcatggtatctcaacaaataggctaataacaaaattctcttacaaatatagctcataaaaaaaattatcaaggtaattcaagcataacatcaattgaacagattaatggtacagaaagtagagtcaaagagattataaggattaactaaccaatggagcttgagacctcactttccttttgtgacagcagattgggatgccacccattgagatgtttcttcaatatcctccatatttataggtgaaactatggtccaatatcagtgactcatttaaatagagcacatgtctagagtcaacaaccgtagaaatttaggtccttaatcaaacagctgaaacacgacagaatgtagacgaaaaagacaccaaatacaaattctgacgggggatttggaatttcaacgattttttcctcttaatccctatgcagggaactctgaaataaaacaaaagcataactttacatctcattttatttcagttagtaaacaataaaacttttaacctttgctatctggggaagtaaatgagttaacacatataacaagatttacagttctaatcaactgaataggcaattagctgttaacagtaaagacaatacctaattctaaggaccatacctaattctgggtacttactaactatgatctcttctcaataatgcctactgattcaagaacaacaaaaaggaagcagattaacaaaagaaagagcaagaagtatcagcacaaactgtctgtcttattgtttattatgaagttcctctgccgatgacgtaaaagatatgccggcagctagccctacaaacaaacttatattttcaagttacttttaatttctataatctcatatcaaatctgccatatttgaaacttctttgcaaatcgaggcaattaagtacgcacaattaactgacatgaacaacgaaaagaggaaaaaggtcactcttgacactacaaaaaaaaacagcgtttagcgacggccttattctgtcgctaaatcaacgtattccgtcgctaaatttgtccctaaaatcctcgttgctaggcttataacgacgacaaatataatccgtcgcagacttagcgtcggattagcgacgacatttttttgtagcgacgacatattttttgtagcaacatttagcgacggaaatatccgtcgctatataacctgtttctgtcgctattttgacgcctttcgtcgctgtaatacctaataaaattcgtcgtttgttcttatagcgacgaaattgtccgacgctagccgcgttatagctactttttgcaacaaaaatattttgtcaccaattcgtcgtaagatttaattttacgctataattttagctacggaacgtattcgtcgctgatatttttttactatattgctgatttttttaaattctttttatttattattttaaatgtagtctattcaaacatattacataaactattaaatacacttaataaaaagtctaaattcaacaaggtcaaaaatatatagcataatgcatataacagtatcgttaagtacaaaaagtccacaaggaccaacaataatatccaaacaaagtaagctaactatactaggctagagagttaatcatcatcagaacccaatacatgaacctcatcaatgtcagcagcatggaccaacaatatattttctctagagcgctgacatcatcaaaggaaacaacctgcaaagtaagacaaagttaaacaaattattattacaatatcaaaaaaagggggtcttgattcaatatagtaaaatagaaacatcaaattggcctaaggttcgaaatacataacattaaaaataaaactataagaagaagacttgcaataattactttacgttcattttgctttaagcacacataggtaaaatccatacaaagaatcaatgcgtcagaaatttctttctagtatcaagtcaagtgcccacaggaggaaaaagaaaacaagctcatcttagatttaggcactcaaataatagccggtaaagaaaggttgtaccgtgtccctatcttatttgttaaaatcaaagaagattatatttccatccagccattgacttccagcacacaatactaacttagaattttttactgcaaaaatattcaccgttagcttgtcctacggcagaggagcttaccaccaagtaactccagatttaagctctccctcaagtgtaaaaaaattccctactttctatcgaacacaccacaccacaccacaaatacagagtagagatcataaaatacttgctttcttgatatcagtcgctccatttttgaatcttgaggttatttcttgtaccttccttttggaatctccaccatcttctatcaaagctgaatgcatcaaaaaattattaatgtcaatgttgcttctctagttcattaatataatttatccaactctccaatttggtgggcataagaaaactccattcttagtaaagacctgcctgatttgaatttcaaaaatagagataccccaaacatcctgttttcccttctcaagcggtagagaagattacctgcatatatgtcagctgatcatagctcaaaagcaagcttcctaatatcaggatgtgatccatcctgccaaagggaggtagatcgaaaagtaggttcaacatcacaaagaagacaagcatacaatagaaagctatgtgcgaaaataaatggatacatggtatatgaaaagaggatattttgacgcaacagatatttggtatctgatgacaacaatggaagtaccgggctaatcggctgaggcatctaatatgcaataagaagcagataaaattgttttgatacaaaacatactttaagatggatttaatagtcttttccaggtagtcagcccgattgcaagccataacaactacagcagccactggcatctagtaaatatagtaattaggtgatgcacaaatttaacagaaatgaaatcaacagatgttgttagtgaaagcatgaataaggatatcagaatgtatgtacacctgtacatttccgatcaacttttttatgcccttacctgtaatatgacaaaaagtcatatttcccaatagatacactcatctcatgttcaacttctgaaataacgagtgatctcacctgtctcgccaccttttgaagcccaaccacatatctagatatactcatgggcaataaaatcggattaaagtaccaagaatatacacccaagcttttatcattcagtagcagcatgtgtaggtcatgttaaaagaggtacctatgtacaatctttccttctcaattttatacagattatgttaaaagaggaacaagaacaaacttaggacatgtgttcacctcaataaatcctcttccagatactgctggaatagagcatgtcaattttattgactgaagtttagcgcgcttgttgacaccatcaacatgttctacctcatcattagcttctgtaaccagataattaccttctaaagcacaaagtaatctgaaaaaagaaacaggttaaggaaggataagcaagactcgatggtattggagaactgcagcacagtgcgcaagaacagcaatgctaaaatcagagttgatcaatatatcgccctgaataatgatgcataccttgtagaaggcttggttaagttatagcctttaactataaactgagctctgtcagatactggcacagctatgggtttgacacttaaaattgaagtatgctcaacagtctcagacggcaaggggacatctaaaagaagctgccctgcatcacattatagcacaaagaaatacaacttactgtgtggaatgcaatagtgtaaaatatatcaacagaagcagttttctttagcgattgtatatcttggggtttggaaggaatttataatgtcagaaaactcaaagacaagaatagaccatcacgcacaaatgcaatttggttttgcacccttatgtaaatccatccttttctccagaaactatcgccagggacatccaaaagcctactcaaactggagctcagatcacaacaaagctgtatgaagcaatataataatagatgtcaacagagaccatagacacagcttaacaagttcaacttattgctttcaacaaacatacctcctcccatgcagactcaggaagccgcagatatactgttaagacaatacaaccaggcctaatgaagctctcaatctcagttggactgtgggatagccagtcaagaatctgcaattacaagacaaagaaaaagaacgtatacgagtgagtacaattacccgatggtacacaaaagaaatttccagaagctgaagttgaagaaatacctgtgctcttaagacatacggaaaatcactacatatttcatatttaagacagcaaatttgacaattccatcgggtacctgctatctaggtacagggtaattctgcctatcaagggccattttactttacaatcccaactcttactctatatcaaccaacacttgggcattgttgtgagaaccgtccaaagcagcatgagaactagcaagaatattgggtaatttatccaatttctgactttgggttacatacacaaaaccccctgcctttgcaaccaagaaagcaaatcaaccaagaaacggacataaccatcccaaatgagctcaaaacatttgctaccaccataaccaacaaattcgaagaactcaaaaggctaccaccacatttgctaactaacaaaaactataacagtaatgaactaccatccaaatcaatttcttacataccaacgttaaaaggaacacatcaaatctgtcaaatagatgcagtaatgaagaaacaaatctaacatcgagaagcagcagtcaaatagttatataataaatcctccatcttaaacacaaatcataaaaataactccaactcagaatttacgggaaaaatttattaaaataccttatgatatgaacaaattccatgttgttatcatatttcgatccatctgcatcaatttataatgaatgtcctgattccattcttacctactttatttgcacactatgtttcaagtattatttccagctttaattatttaaattaattctgtgggaatgaagagacttaggaagttcaacagaaagtcctttgaattactcaagaaaaaagcctattggcctattctaaattaagatctgcattaatatccattaattgctcttcttttaatagagcaactgtttatagatcctcaatcatgttcaatcaaatagaattgtaaaatatttcagagaagaagtatgagtcaatgggaagaagagtgggactcgtcgtcaagaaagaagcagctgaaacgttaaaattcttagcccacgtgtatctctggtcgatgaacacatacagattaaaggataaaaaagatagctacaaatatctatagttcccctaagcaaaaacataaaaaatacagtaataagaacagcaatgtagtaaatttccctaagcttcgtgtgaagtcacagctgaagcgacagtagcatcggcggcggcagggatggtggcggcagggatggcggcagcaggggcggtgctagcagcggcagcaagtatggcggcagcaggggcggtgctagcagcagcagcagggatggcggcatcagcagcggtgctagcagcggcagcagcgatggcggcagcaggggcggtgctagcagcggcagcaggggcggtgctagcagtggcagcagggatggcgacatatgcagcatatgcagcggtgctagcagcggcagcagggatggcggcatcaacggcggtgctagcagcggcagcctgtgtggccttcttcctgcaataatattcataaaaaaaaaaatttaacccagccctaaacacacattgcaaaagaaatgaatatatttgaagaaaaactagaacctgtcacaaacagcaaagtactccaaaaagctcttaaaagcacgagagcaacacaaatcccaacagcccaacaagtctccctaccatttttgtgaaactctttgattgagaagttaacaaagatagcacaaaatgtgtagaatagaccaaagtcagtggcaactggtctaagcaagactatggcgaagaaaatagaaaacacagctgctaaaaggatccagtaaaggtaaggtccaatggcatcacccttacgaccatccaatgcaaaagcaaccccaatacccatgagtggaccaactgggttgcaaagttttgcaaaactctgttcaataccagttccatccaagatataatccctcagaatatcagcgactggtgccaaataagctagtaaagcaaacatgataataccaatagctaagaaggtccattggtagtcattttctaccacagcgccatccatgaaaaggagtatcatacatgcgcaataggaaagtaagaacaatgtgatcaagaaaaatctttccatggttattgctgcagaagaagaaaagcaagagttggtttggagaagctaaggggagaaaatgagaaagatttcggaagaggagcaaaagtaagtgtggactgtggagtggagaagcttaaatagcataagtctttgctttttattattaaaatgatttttaattttatactccttccatcctaaaatacttttcatttgtcacttctcaatatttaaacaagacttttaaattataatagtacttctcgtataattttagaatacttaaattttatttgtattttaaaacaataatataatttaattgctttaagaattaatcaaatttattcttgaaaaatgaaatgtgaaaaatattttatataggaccataggctgatctagtatttaagttttatgggttcaacctgtaaacttattagcattaaactcattgtatttttaaagttacgggttcatattgctatatattacaatattattaaatttttacacataaatttatgatgcgcaccaaaagtattggatacagttgaacccggaacaaataccttgcatccgcctctgcatatgacggatgggataatttaattatttgtattcaactagaattgctctccctcaaaatgaacaaaaagattcaaaataaggtgtaatcgctgtaaaactaatagtcaaaaaaatatataaattatttgtatgttacatacgaaaattatataagatttatatttttcggttacaaaaataaataatttttgaaatggattaaaaataatattaatacccaacaaaaaatgtcatacttgtgttttactaaaaattgggataaagaatctcatcattaccttttattatatttaatgctaagccaatatgacggctacttttgttgtcatagcaaaattttggagtttcgtaaagattttagattttttgggggaagcgccttacttaagatccttctctatttttctcttttcattattatcttgtttaatttgattttattgttttacacttttctagatttattaactactccaatccctccgttcattttttgggggaagcgtatttgttacttagacaacacgtgccaaaaattttgggtattacccctcttagcacgtgctaaaaattatttatattcagtagataaaaaaataaataaaatttgtataatatttatatataacatgcaaaatgtatatatatatacaaaataaatattttttgctattatttcgagagcggctatacaacgtcattttcccatttaaaaattgtgaaactacgtttgtatcttcgctacaatattctaaaattttccgaatttttgtacaatatctcttttctttaaaattatcttcttcccattaactgttgtatttttcttaaaactcctgtacgttactattttccataaagaaattctttaaattaaagtattatcaaaattaataattgtgtagggatattattcgaaattgagtttgtatgtgtttattaaactcaaaacattctttgtgataaaagatgagctaattacttaaatagtcatctaataatatataaaaacaaaacaatattaatactgttgtactttctgtagcaatataatcagtaacttgaatacccattattctagaaaataactctatagagtgagactacctaattatgctttacttgatagtattgtacatttttagtgggtgtttggacataagaattgtaaattccaaacagtgaaaaaaaattcacgtaaaatgatattttaaaattacaattgtgtttgaatatgaattatatttgggttatttttgaatttttttaagtaaacatttgaaaactagcttttgacaattttatatattttcagaaaatttcaaaatacattttaaaatgaaaattagaatattatagctaaatagtcatttcgcaaaaaaagtgattttttctaaaagaaaattaataattcatggtcaaacggctcttaggacccgtttggtatagattttaccaaaataaatttgggttttattcggcaaacacatatttgaccataaattttgcctacattttgaaaacggatattcaaacatattctcattttcaaaccaaacttcattcaaataaattttttcaaaataaatttaagaatttatggccaaatagtagcgtagactttataaatcttgcttgcattttatcttataatagttgacaaaacaaatattttaataaaagatatactaaaggtccaaaggataataaatatgagaatcttgtagaatcttctctaaaggttgtaactatcctctttgtacctttttttataaagttaggcacacaaaaacgtggaaatgctttcatttacctttttacttgtatatttcatgattcaaaggataataaattacaaatcattaatcacttaaaaatattgtggacattacaaaagtaagcatgttgatttttttttacttttttttcgaaatctgtatttggtcataaaatttctaattattatttaaagataaattttgaaatttcttgaaaatttgaaaaacttcagaaaaaactgtttttcaaaattcactcagattactcacaaaatttcaaaatccaaaattatatttatgttcaaccataactctaattttcaattaccgttttctcttaaaaaaatattacaattcttatgtccaaaagcccacaaagtaatactaataccgaaaaaaaaatcatgataaaggtagcaatattcaattttcatatatttgaatattaaaatactttagttaaactccttaagagagttgcgcaccaattctagtgtaaacaaatgttgtggggcccatatataaaaggttggaatgaacttgaattgattttaacaacagaaaataggcgggtggaaatgcagacaaagattgacagcctctgtttctgagcatttctgtttaggcggcgtggcactatggataaagcatacacaacgtacggatagcagtgtgcaataaatgctttaatcttaacaagcaaaaggattttattggatggccaaaaaatatatactttgcttttgataattatttatatgaacaaaaaacagtagagtttctttaaatatataaatactccctccggtccaaaataagtaattttttggatgttttcacacagattaagaaatttaccttttagcattaattagcaatggaattgaccatattaacatttactatctcacataaatactcctaacacatattccaatactatttactccaaggacaatgtaggaaaaaaataattaattcactcttgaaattcgaaaaaatcacttattttggaccacaagaaaaataccaaaaaatcacttattttgaaccggagggagtattaaatttccttcggatgaggttgtcttgttaaattaaaaaatataaagtttaaatccgaacctctactctatattcaatttatggttgaaacaacttgactatatccaaatattcttcattgacctatataagtgaaatatatgggagagaagatgacaaaattacaatcccaaacctattagaaagagtggatgggggaaaccccaaaacttcagtatgacagtaaaaagagctgtcaaattggggtgcagacaatgatgagattttttgcctgaattatctttttgtaaaagtgaaactacctcttttctcactccctgaattatatttttatggtcatccacgccaaaacctggaaatgctcttgttcatttaaattgagcccgtttggacataattttttaaaaaaaaattcaaaatcaataatttggaattcaattgaagatgaattttaaaaaatttcaaaaatttaaaaaacttaaaacaatttaaaaatttaaaaatcaacaaaaataaaatatattactattattttttacaaataaaaataatgcaataatattaaattgataataagataaaaatcacctatagcatcttatcttacaaacgattaaaatatcataatatttctccctttttacctctctaaaagttgataatcaataaactccatcattattactccttacgataaactcacattgaagaattttgggatcacacagaatttccctcaaatatatatatatatatatatatatatatatatatatatatatatatatatatatatatatattaatttgagatgactgatttgtgcatgctgttaggtgttcaattttgggttcaaagttcaaaagggcaccctacattatttaggttatgttatgaacaattcaaggacgtgttagtatgcttttaggcacgtttttaactattgtatttttcataaaactcttgtactttactattttccataaagaaattctttaaattaaagtattatcaaaattaatatttgtgtaaggatattattcgaaattgagtttgtgtatctttattaaactcaaaagtttcttttgataaaagatgtgctaattacttaaatagtcatctaataagatataagaacaaaacaataaaatgactgtcctattttttgtaacaatataatcaataatatgataccccattattctagaaaataactctagcgtgagactacctaattatgctttatttgatagtattgtgcatttttagtgggtgtttggacataagaattgtaaaatttcaaaaaagtttaaaaaaaaagctttatgtgaaaatgatatttgaaattagagttgtgtttggacatgaattaattttgggttgtgtttgaatttttgtgagcgatttgagtaaattttttgaaaaatagctttttggaaattcttaaattttcaaaaaattttaaaattcatcatcaaatgaaaattagaatttatagctaaataataatttcgaaaaaagtgaaatcctttctagaaaatattaatttgaataaaataatgcagctttctagaattttaatacactaagtttactgaacacttcgaattaaataattatatgatttttcatgtaattgctaaccttaaggaccatttgcacttgctagctagttacaagtagaggcgaattcagaattttaagcttatggattcctataatcttaagttaatctacataataactagaccaacgaactgggttctaagctgaatatttttatacttttaatgaattttttagtacaaatacaaggtctatgcaaaagttactgggttcacgggaacccgtaacctttgctctagatccgcccctggttacaagtcattaatcacttaagaatattgtggatattacaactataaatcattgctatttttcataataagcatgttgaatttttcaaaaaaaaaaaattacacttcttttcaaaattagtgttcggccataagatttcaaattttcacttaaagataaattttagattttttcgaaaatttgaaaaattccaaaaaggtaattttcaaaattcactcaaatcacccacaaatcttaaaacccaaaattatattcatgtttaaatacaactctaattttcaaatatcgttttcatttttaaaaaattagactttttttatttggaattttacaattcttatgtccgaacgcaaagtaatggtaatatcaaaataaattaggataaaggaagtagtattcaattttcatatatttttaatattaaatagtgctttggttaatcaacaatttttttatcattaaaactcctttgtgtttaagaaaattgtgtaccaaattctagtaggaatacaaacgttgtgggacccatgtataaaaggttggtattaacagcaacagaattagcctggttcaatgcagacaaagctgaatatcctctgttttttctttttgtacttttgtgagcattcagttcaggcgcgtggcactatgggcatagtacaacgtgcggatacccgagtgcattaaatgctttaatcttaacaaggaaaagaatttgaattgatgaccaaacaatatatattttgattttgatcaattattttatgaacgaaaaacagtaatatttcttcaggttaaaaagttattaaatgtataaaaatattaaatttaaaatccaaatttccttcagatgagattgtcttctaaaattaaaaaacataaagtttaaatccgaacctctactctatattcaatttatggttgaaacaacttgactaaatacaaagaaatttactattccctcttatggtttttttttttgctaaaataagtatttttttcatattaataatgaattaattattattttcctacattgtccttggaataaatagtattggggtatgtgttaggagtgtttatgtgagataaaaaaggttaatatggtcaatttcattgctaattaatgttaaaagatgaatttcttaatctgtatgaaagcatctaaaaaatcacttattttggacctgatggagtatatatgttagcaatcgcgaattgtattggataatactacttaggggtattcaagtcgaaccgaaaaattgcaccgaaccccaaaactcaaactaaaccaattaaaaaatttgactaggtttgatttgatttgtttggtattgagtagcaaaacatgaaccaaaccgacatataaatatataacttttaatatacttttaagactttatatagaattttctttaataattatttagaaatatttgggatcctctcatgggatgtaattaatatttatatgaaatgcattcttttttatttactttaagtaatggttatatcactttcttatcaagtattattaaaatatgtcagttatcactttgttcttccatattcatatgtcagtatttcttatatctttttcgaatttgaaatacatttcaataatttaaaattaaatagaatatatcattctttaggtatcatattgatttttatatttatttactaaatttggttaacattaaaagcgtacatcaacaaaaacttattattagacgcctaagaaaataactatcatgtgttactaaaaatatctttcataagaacattttaacacatcatatatttgtcaattttttcaccttttactaaacatatattcagttatcaaaaatttatctataactttaacaaaataaatattgaaaaacgtttacgtaaaaaaaaaagctcaaaacattcaaaaagcccgataaaatcaaatcaatccaaacctatatatattagtaattggtttgatttttgataaaaaccgaacaaatacggtccatatacactcgtaataactactagtatgagaatgcagaaaatgagaagctcaatgatgagggataagtattttatagtgtagttgttttctttatcgggtttccgaggacatggcccttgataggaaagtctggcggtctagtatcagggttgtaggataggggctcccagaatttttcgtactcctgtcgcggggttgggtaaggcttggcagagctatctatagatgatttgtgtattggtttgtgtctcccttatgatagttatttatgatcggtattgtttgatattattgcatgtcattttatttacggttcttatatttatggttcttatgtttagttatttatggccgttactgtttgatattattacgcgatttctgctggagttactaatgctcttgtttttgttttgtttttgtttttcctttcctttcctttcctgagccgagggtcgcttggaaacagcctctctgccctttcgggtaggggtaaggccggtctacatattaccctccacagaccccactttgtgggaatatactaggtagtagttgttgttagttgttgaaggaagttgttacacgtgacctttgttattcctagtgaaccgttcaatgaatattccaatacccattatatccaactattctcatcaagagtaaaaataacattttctcatcatcggctaattaaaaattattggacattttttgacgaggtaggtgtcaatatatccaactattcttcattgaactatataagtggaatttatgggagagaagatgacaaagttacaatctcaaacctattagaaggagtggagtgggggaaaaccccaaaacatcagtatgacagtaaaaagagctgtcaaattgggatgcagacaatgatgagattttttgcccaatttttgtaaaagtgaaactacctcttttctcactccctgaattacctttttttatggtcagccacgccaaaacctggaaacgctcttgttcatttaaattgagcccgtttggacattattttttttattttttttttcgaaatcagtatttgattataaaaattttaatttttacttgaatatgaattttgaaatttttaaaaaatttaaaaaactctgaacaattttaaaatttaaaatatgtaaataatgaaatactgttatatttacttctataagataaaactcaactataacatcttatcttacaaacgactaaactatcataatattttaaaaaggcagaatagcctaaatgacacctgtacttagcccgttttgtcatgccggtccccaaacttatatatttgccaattgaacacttatacccgttcaaaagatgaataataaacgcttataagtgttcaattggcaatgcgtgtgttacaatcgcctacatgttggatgccaattgaacacttataagcgtttattattcatcttttgaacgggtataagtgttcaattggcaaatatataagtttgggaaccgacatgacaaaacgggctaagtacaggtgccatttaggccattctgctttttaaaaatattatacaaattacacgatttacggtacctctttaaaagttgataatcaacactaaactccatcaatattactcacattggagaattttgggaccacacgattttcactcaaattcttttttcttgctcacaaaggcacacaccctcctgcatgttgatatagttgtaaaatatacttatatctttgagatagactgatttgtgcatgctattagtgttcaattttgggttcaaaattcaaaagccaccctacatctatccttctctattttgcattattatcttgtttgatttgattatactctattgaattattttcaatatttttacaataataacagccatgcatgcattgttagaaaaaagatattagtagggaaattagttcataaatactcgaaaaaaaatatagtaaatctatgttgtatatatttgtatatgcacttgggaccccttaaataattttcctggctccctcaacaacaaaaacagaatggaagagctgattttcgtagcttgttgagagcttcagatacctggtgaacctgggttcaaaccaggctattgcacttttcattttcatttttactttcttttaattttttaaattcaacgactgtttacgtaggtctcagtagttttttttttttttttgaattcttaagtatttgtacccgataatcaacctaaagttataacctttttcaaactcaaaagcaaaagcaacccttccgcctctcatctcccttttttcaaataaaagtaaaccctctgttcaccccttgtgctaaaaaataaaaacaaaaactttttcaaacaattgttttaaccttattctgtgtctgttcgagctcgactttgacagtccgaatcggtgatggctattgagtttgagactcttcttcagctgaaacagtaagtttatttgagtaaattttaattttatctgagtaattttctttcttttgaaaatattaacatagcaaaataatttggtatcaaaattttgctttctgtaaagagttttagagccaaaacgtgaacctaaagtttgtattttgctgataaattattatactcattatgtttttatagagttatacgccgaactttatgactagtaattggcatgcttaagataatggtgcccccgtcgtgttcaaatcctgggtccgcctctgtatatattgcaattacttattacataaaaaggaactgaaatgtattaaatttataagttaagatcttttatattgattgaagcccaattcatgatctttcccatttctttatcttgtcccttagtttgctaatctctcccaaaagcaatgaatattttttttttttacaaatatcgtataatagattattttgattagtttttttgtggggataaagcgcgcgcgcgcgcgcgcacacacacacacacacatatatatatatatatatatatatatatatatatatatatatatatatatatatatatatatatatatatatatatatatatagtctccttttatttttatgcaattttacctgtttatatacatttactgtaattatattattttataaaatattaaaaattaaatatttatgagacttacgccccgtgcctcagagcttacgtctcgtcttatgcactcgctttttaaaatactgggacaactaatggtttttttttcctgaattaattgcaactcctaagatatggaatttaacagaacagaataataatgcgtttgaaaggttacttcaattaatggtatggccttcagccaaaatgaagaacgaattaataaataagaaaaaaggaaaataatactccgttttttagcttagtttatacaagatcgagaccatgccttggtcataaatgtacgtatattagtgttttgactgtttgtacgagaaacaagcgtcaaatatatgattaaaaatattacaagtcactaatcacttaaaagtattgtggatattacatgggtaagcatgttgatttttttcgaatttttttttggccataaaagttttaattattacttgaaaataaattttaaaaacgccaaaaagaactatttccaaaattcactcaaatcactcacaaaatttaaaaaataacccaaaattatattcatgttcaaccacaacttaacttttcaattattattttcacttaaaaattattagactttttttggaattttacaattcttatgtccaaacgcccacaaagtaatactaaaataataccaaaaaaagaaggataaaggtggtaatattcaattttcatatatttgaatattaaaatactttagttaaactacttaagaaagttgcgcaccaattctagtgtaaacaaatgttgtgggacccatttgtaaaaggttggaatgaacatgaattgattttagcaacagaaaatagtcaggtacaaatgcagaccatgcgtacggatagccttgtgaattaaatgctttaatcttaacatacgataaactcgcattggagaattttgggaccacacgattttccctcaaaatccttttttcttgcttataaaggcacacacccacatgtgatatatatatatatatcacatgctcacatataagaagctaatataattgtaaaatatactcgctccgatttacaataagtaatcaatttactttttttattttgtttcaaaataagtgtccagacagtataattaggtaatcaagaaaaaatttaatttatttttactcttttacccttatgtgcatattcttaaaaagttttctcactctttattataactatgtgaccaatatttaataatgatagtttagtcatactaggtatttttgtataggatttaacatttttttaatgggcatgctaaaagaaaactgatcgcttattgtgaacgggagggagtatatctttgagatgactgatttgtgcatgctattaggtgttcaatttttgggttcaaagttcaaaaggcaccctacatcaattatgttatgtaatgagtaatttcacaacactagaacccgaaaacaattcaagaacgcattagtatgcttttaggcacatttttaaataagcaaattatcgtaattacgtactcgttcgcgtcacatagttataattcgcaaaatgaatcaaggtaggcgttcatgcgacttaggccaaacaattttaatattaattaagggttattaattatgtacatgtatgcgtgacatgatttttagcgcactaaataaaataagtacacatgcgcgtaacccattttaaaataattcattaatcacaaataaacgagattttaaatttttatacataaatttacgatgagggccaaaagttaggcacaaaaaaacgaggaaatgctttcatttaactttttacttgtataggaaagcatattgatttttttcaaaatctttttttcttaaatcattatttgaccataaacttttcaattttcattgaagatgaattttaaataagtatttgaccaaataaaacatgcacattcttgtacagtttaaaaagctgaacagtttggacaatgttttatcattagcgattcttttgtgtaatgttacaatagttttttgtttgtaaatggtttggagcgggtttagagggttgtccgcttatgtggctgtcatgtcacggccacgtggatgccatgtaggattaaaatggcttgtgatgtggaaggctattaagttgaaggacatttttggcccattgtgttaagttgggggacatttttggcccactttagagggttgtccgcttatgtggttgccatgtcatagccacgcggatgccatgtaagattaaaatggcttgtgtggaaggctgttaagttgagggacatttttggctcgctttactaacggcgaggatatttttggcccactttactaacggaggacataactgagctatataccatagtttagggatatttttgcccttttccggataataaattacaagtcattaatcactttaaaatattgtggatatacataggtaagcatgttgatttttttcaaaatattctttttttaaaatcagtatttgaccataaaatttttaatttttattgaagatgaattttaaaaattttcaaatatttaaaaaaatccaaaaaactatttttaaaaaatttactcagatcacacacaaaaatttcaaaataactcaaaaaattatattcatattcaaacacaactccaattttcaaatatcattttcacttaaaaatattatttagacttttttcttttttggaattttacaattcttatgtccaaatgcccacaaagtaatagtaataccaaaataaaattaggataaaggaagtagtattcaatttccatatatttttaatattgaatactttggttaatcaacattttgtttaccattaaaaccctctttgtgtttaagaaaattgtacaccaaattttagaggaagataaacgttgtgggacccatgtataaaaggttggaattaagagcaacagaaaataaccataacctggtgcaaatgcagacaaagttgaaagatgttcagtctctattttgtttgtccttttgtgagcatttctgtttaggcgcgtggccctacgggtttagtatatacaacgtccagatattaaatgctttaatcttaacaagcaaaataatttgattggatgaccaaaaaatatatactttacttttgataattatttttatgaacaaaaaacagtagaatttcttcaggttaaaaagttattaaatgtataaatattaaatttaaaattcaaatttccttccgatgaggctgtcttctaaaattaaaaaatatacactttaaatccgaacctctactctatattcaatttatggttgaaacaacttgactaactataaagaaatttactatttatgttagcaatcgtgaattgtattggataatatagtactacttaggagtcgtttggtagccggttagagaggagttatacatgtattaaaactaggataactttatacattgtttggttaaaagaaggagaaaaaataatctccacatagaagctagcataagttatacaatgtttggttgctttttcctcttttctacataaaatgtagcattgctaatacaatgtttggttcatgtttttcttttccgcataactaatacatgtataagttatgagggaatctatgtattatttatgcaaggtagaaagtggaataacttatacatgtattagtaatacttgtattaaaacacaaaatgacaagaataccctttattcaaacttgtatttttttgtttaaaaaaatatatttaaactatactaacaattaaaaataaagtaagctaataataaataacactcacattacatttctacggctaatccttatataactacacataactaatcctcgcataactaatccatgcataactaatacatacataactaataccttgcataacttatccctgcataactaataccttgcataacttattccctgcataactaatacatgcataactaatccctgcataactaatacatacataactaatacctgcataactaatacatgtataactaatacatgtataactaatacttgcataacttctaaccggcaaccaaacgaccccttaggggtttcaagtcgaaccgcaaaatcgcaccataccctaaaagtcaaatcaaaccaattgaaaaatccgactatgtttgatttgatttatttggtattgagtaataaaacctaaaccaaactaacatataaatatatattttttaatatactattaagactttatatagaattttctttaataaatatttagaaatatttttgatcctctcatggatgtaatatttatatgaaatacattctttcttatttactttaattaataattatatcactttcttatcaagtgttattaaaatgggtcagttatctttttgttcttccatattcatatgtcaatatttcttatatcgttttcgaatttgaaatagtatttcaataatttaaaatcaaatagactatcattatttgggtatcatattgatttttatgtttaattactaaatttggttagcattaaaagtgtacatcaccaacacttattgttagacgcctaagaaaataactatcatgtgttactaaaaacctcttccataaaaacattttaaaacatcatatatttgtaattttttcactttttactaaacatatattcaattatcaaaactttacctataaatttaacaaaataaatattgaaaaatatttacataacaaaaaaactaaaaagtttaaaaaacccgataaaaccaaaccaatccaaacttatatgttaattggtttgatttttgataaaaaatcgaacaaatacggtccatatacactcctaataactactagtatgagaatgtagaaaatgagaagctcaatgatgagggataagtattttatagtgtagttgttttctttattcaaggaagttgttacacgtgacctttgttattcctagtgaacccttcaatgaatattccaatatccattatttaaatgcatgcattttcacaaaaaacacgttttttctttagctttttttctttcttttcttcccgcaatgctaatatactgcaaaggtaaaagcttaacattttaaaatccatatataatcaaaataatatagagtaaataaacattttctcatcgtcggctaataaattatctcaaaaaatttattggacattttttgacgaggtaggtgtcaataatccaattattctttattgacctatataagtgaaatttatgggagagaagatgacaaaattacactctcaaacttatttgaaagagtggatgggggaaatttttttacaaaattgattataaattttttattttttacttgaatatgaatttttaaatttttaaaaaattaagaaaactccgaacatttcaaaatttaaaatatgaaatatgtaaataattaaatactgttatatttactagtataagataaaactcatattggagaattttgggaccacacgattttccctcgaatccttttttcttgctcacaaaggcacacaccctcctgcatgcatgttgatatagttgtaaaatatatatctttgagatagactgatttgtgcatgctattaggggtgtgtttggtataatgaaaaatgttttccgtggaaaatattttccaaaaaaatattttcttggaaaacaagtagtaatcttactcatttttcggtgtttggtatgcaaattaaggaaaatgacttctcaagagtattcataaataatttagatataataaatatgaagccataaacttccaaagtaacaaccttctggaccaacatatttcataaactttcgaaccgctaaacattcaaaaccgcgaaattcgaactcgtaaactttcaaacacataaacctctgaactcataattttggaacttgtaaaattttgagcatttaaaaccgataaataataaaattaaaactgaaaaatatattttaaaaaaacaaattcggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattgaaggtgaaaaaatattttttttgcgggtgggtggggtggggtggggtggagtgggtagtatcgaaaaaactgaaatttaaaaaaaaatgccttttttgggagagggggtggggtggggtggggtggggtgggttagtgagggtggggaaaggttgagaagaggtttggaaaatgttttcccttcttttgataaggaaaacattttcctccaattggaggaaaatgaattgataaggaaaatattttccaaaacatttaagccaaccaaacatgggaaaattggaaaacgttttccggaaaatgttttccttcataccaaacacaccctagatgttcaattttgggttcaaaggtcaaaagccaccctacatccttctctattttttattattatcttgtttaatttgattatactttattgaattatttttaatatttttacaacaataacaatcattagtggcggatccagaatttttatcaagcgggttcaaaaaaaaaaattaaaagtcatatgtgactagctagtttcgagctcaggaccatgtgaaaaatttgaaccctctttaccaacaagctagatattttactagttaatgttatttttttaaaaggaccaaacatttccagtttggttatcgagtatttatttatacaaaaaaaacttgtaaagcaaactaaattaattcaaaatagattgaaccgaatcgaattaattcaaaacagagcaaaccgatctaatgtactccctaaatcaatctctttgactattgataaatttatattaaatacagtggtacccgtaatcattagatcttggatccacctatatatctatatatttgaaccattcagctactcctatatatcatattttgcaagtataagagttttttcctttgtgctccgtgagagctattagagcgagttctactttttgaataaatgaattaaaacaaagaatattattagtagaattttcataattcctggagagatggtgtactaacatatcgaagtaaaattaattcatttggtccattatttagatagaatttgctagacactccaataaattaaaatatttatttatcgagctcccttttcaatcttattaggtttaaataaatagtcatttatacaatggcattagctaggcatctcatttaccggcaactccttccatttggcctctgtttttttgaagctaacattgtatgagtattgagtacatcagcagggatggcagcggggcggggcggggcggctttaatgttatgcgggtgcgggacgggtgcaggatgggttcaaatttttaaaaagtatttaaaacgagtctgaagccttcaattttactaaataaactaaaggatcataaatttcggagccaaagctaaatcaacccgtgaaagaaaaacaacaatgaaagaaataaaaataacagtgcatataaaagtctctctctaaggtactatattttatatacaaagcaaaaataaatgttgagaagggaaaaagtgagtatattaattagcatttcactgtctgaagctgaattttttttaaaaatatttctgaaaaatagagatgaatgatgtctcaagttagaaaaagatttgccaccgaattactcctcattaaaaaaataaaaaaaaattgttatatgggacgatgcggggcgggtttatgcggagtgaaatggggcgggatgaaaatagaaaaactgctatgcggagcggggcgggttaaaatcttcgcgggttaagattcaacccgcccgcaaatcgcctcgctccgccccattgccatatctaactatacatgatagtaattctttaaaatggtgagcatagcaataatttgaatcattattttgggtcatttcgagtggcggagccaccttcacccaagaggtgtcacccaatggtgagcgcgtgcttatggacctattgtgacgatccgacccgtcatctcatgtatttccgtcccgttttccccgttatatgcttactcatatttcaatatgtgtacttggtgaatttgagtcaattcggatcgagtttggtaggaaatgggacaattagtctctttaaggaagaattagtttggaaaagtcaatcggatgttgacttgtgagtgagagggctcggaattgagttccgatgattcggttagtttcgggggatgatttaaggcttaggagcgcaatcggaatgaattttggaggtccggtgtgaatgttagcctattttggcgaaattagaatttcggatggattcgcacaaggctccgctttaaaagagcacatctaattatgtataaggttttatgtggtaaatagcatatcaaatgaaaggactttgagtctagtttccaacgcttcaagccgttcgtcattcggacattcctacacaaagttatgatcaaattaccaaatgcagcgaagaattttgcactaccgcgtagcggccccgcggcgcgccaccgcggcgcgccagtgcaagttatcagagacctccaatttcgttccagaaagcatttttgcactatcgtgtagcggccccgcggcgcggcagttcaaaaatgggtttttaagacccgaaccccatttcatttaactcgacttagggttcatttttgggtatttttctggcgttttagagagaggggagagcgttttagagagagaaagaagcataagtttcatggttcatcaaatcttgtacaaaccttgaaatctctcaagttcttcagcaaagcggtgagaatttctctttccccagctttgagaacctttggagcaaaaaggaagagggaatcgaagggaatttgatcggaggtaagtttcttgactcaataacatcatttaatcatggttttagcccttaaatttctgaaatcaaatcaaattgggaaagaactagggcttgaaatttcaaatgaagatttgcgatttggaggagtaattggaatccgattttgatgaactttatatgtacggactcgtggtgagacgaggaatccgttggtatgattttcggaatttttcgagaagtgggcccggggctcgggttttaccaacttcgtgaatttcgatgcttttcgagtatttttgattgggttaaccttatttagcacatatttatgtaatcgtggtggttttgactaggttcgacgcgcgaagagggcgattcgagaggaaaaggcatcgcggaccagtccacggccagttagaggtaagtagtggggatagatgatggcctgagggtttgaaaccccgttttagcacatcgtgacgctatgttagggcgtgactcgcactccatggcaagtgcggggttggttatgactggggattgtgatttagtccatcccgaacaagaattatattatattggcgactgaaacgcaccctatactgattatacctgggcttaatgccatgtttggggccttgtgccgatctatagcatccccctaggatggatattaatgtgatagcatgatttgcttaatcatttggtctcagtcctgtgtttattcattgtcatgaaatgctaagtcacctttcttgaaagttaatcaacgaaatgatgttttcttaataattggaactgaggacttaattgaatctattatgtgactcatatgcatattgtggactgagcatgggacgggctgcatgccgcagtaatgatatgatgatattgcgcttgggctgtaggagcccctccggagtctgtacacacccccagtgagcgcgggtacccagatggagcgggctgcacgccgcagtggtcatgtgcattgcattgcattcatgcatttatattctgtgatatatctgatgtttaaaatgtgtaaaacggttagctttagctttactttgtggtattttgtggttttctcaccttcgggtattatatatgcttactactcactgagttggtagactcaccccctactccctgcaccttgtgtgcagatccaggttttccggaggcttagctgagcagttgctgtctccagagttgttccgagtcgttgaggtagctgcttgacgttcgcaggacccgactgctctccctttcagttgcttattatattccagacttatatatttctttgtttcagagattattatttagtcagtttttagaggctctagactcgtgaccccagatcttttgggagtgttatatcagtcttcgtattattctattatgattattggattattattctaaactaaaacattctttctgaaattattggttattgagagtaaatgttgctttgaaagtgagtgttggtcaggcttgcctagccttacggccgggcgccatcacgaccgggtttgggtcgtgacaagttggtatcagagcctaggttactaggcctcacgagtcatgagccggtttagtagagtcttgtggatcggtacgtagacgtccgtatcatatccacgggaggctacagaactttaggaaaacttcacattcttggaattcttatcgtgcgtacttgattcagcttgaaatataactcttgaaattccttcctcacgtttgtatgcgcatacgagcgctcagtattacatgtgccttgatggcttgcgattccccgatcgaggggcgagatgtgatttccgtgagttgatgcgagctggtattatgagctattgggttcggtattgtccctaattgtaggaatggcagctagatagttacgtgatgagtacgttagtgctgcgaggtgtatctatacaactgggaaatgtcgagggaggtctgctggattataggtgaactacagagtgttgatgtccattgcgatgatgtgtagccccaagttacgggtacgtgaagatcttttcatgtctcctgtttggagtgaagtaaatttcatattacggtgtgagtttagactcaggaagagtaagtgattgtgtaatgtgtatggcagcggaaggcatacaaaattattaactaaaggtaaagctaatgggtaattggcatatgaggagaatctatttgcatactagttagatgagtctgggagctgagatcgcttctgtaaaggtattatgttgcaatcattgagtcaaggagaccaccttgaaggtcgaaaacatttaaaggaagaatatgttcttacttggttgaatagcccaataatggagggttgaaaggtatttttatgagttatgattcagatagatgcaacgcatgcccatgtatcaattttgatagtataatacctgtagtattgagatttatgtaatcaatatgcattgtgatgctttgtcaagttgtggatgtatggttaggataggtttggtgattctctggcaggtggttaggcctaatttcaagggagactctgccgaatttttggaaaaatttgggacttagtggaaattttgttgccttaagagtgggcttaatagttgtgtgaatgagtgcaagaattgcagaagaattagaatttctgatgattcgtgcttccacaagcttatgaaggtgtgggtttaatcttatcatgatatttcgatggcaatagagtatatgggttgtgaagtatatgacttcaagcgaagctggggagattgatggtgattagttgattgtacggttaagtactacgattagtcccgatctgatgcatgcgggtgaatcggttctggttgcagaaagtgagccgggggtggctcgagtgaagcaaaattctgccaacgattatatggtgtttcgtatatgtggaagaaaataagagaatgtcttgagttgttaatagagaggatgcttagagtaaagaggatgaagttgctcggttgtatcagaatgagatcatgtcttgcggtgtcagagtgttgatgaggcacgagaggttcgatgcattaagtcaagtgatttgttgcgtgtataagagtggatgacttttaagaatggttttgatgtgttcagggttctacaagtgtcactcaggtgtttaaggttgtgggtgtggtcggagacagtgttttcatcagagatgtcaagactggtggtatttttaagctaactgagagactcgatgtgtcagcagctggaaagtaaaggcagcggacgtagattcgcgggaagttcttcagagtagggtattttagaatgtggtattttttggagcaatcgagggagtattcggtggcctaagggtcatagttagtgtggtcttacattcaggtctcatgtggtaagctcgggttgaggcattgtgatgctgcgacgagggagaaatatcaagttgatgatgaaaacaaagagggagattgaatagatggaatagtttgatagtaggccgaatcggtacggtcaagatatgattaattccttgtctatgttcgaggtaatgagcccttacaggcattggggcggcggagctttcgagttcagacagcttgcttagactggtgtgaattagaaggatttagtcctggcagtttaacttgtgattaggaaaaagggagatggagtcctcaggttatcctagtatggcacggtatatgcgatatgttgtgaaggattgggatttatatgggtaaggtacggtacagtccgaaatggaaagtcatgacaatcttaagcagcacggacagctgcaggtaatttatgaatcgatctttagatgatttaggaaagtggtactgctattctagtgatctggcgggggtatacgttcgataacccttcggtgggatttcggcaggttctcgttggtccgactaatgacattggagtttgttgatggcacagagaaattttagaatatttttcgtgggatgaatgaattcttgatgtgtgatatgtattcatacggcggaatgtgggatcaggtatagtgatttgtgtgttatatggagttggagactgggagttctccgacacagtctatctcgcggttgtggatcaggtgtagtcggcaccgtttagcggaaattacgatgtggagactggagtggatctttaatggtgatatgttggatttgtggatatgttgttgggtgtagactggttgtctcagtgttggattattctagactattgtgctacgggctatgtcggaaaatgccacaggttgcgtggcgaggtgcatcggattatgttgtagcagaatgggtgtattccaaagatcggcggacagctggggaggattgcttcccttaattaggccttcgtggcagatgtcagtgtagaggttttaccattgactcagttccggtaatgagggacttttcggacgcatttcttatggccgggcatgttgtcgggtgagattgtggatttcgatatctactgggtgtcgggcatcgtatcgtatggctccggcatgagttatagtagtggaggaagcagcgccaggcttcttggtaatgagtttgttagtaagcggattggatacctgtttagcttgagttggcttggttagccccgaatcgtattgaggaaggataggttgattcgatcgttattaaacctgctagtgatcgggacagatctatgaatcgcctttctgtgctaagaggcgttatgattttcggacggtggcgcatatattgcggtgccatcgggactcataaggggagtcgagttttgtagcttacaacacaataagtagatatcattatgcactcagtgtgcttacgaccgatactcggtatttggctataataagcaaatttggctcaatgtgcatctccctatgtgagatagttgtgtggatcgggtggcacgccgccacgggtatgttatctggatcgggttgcgcgccgcaacagtgtggcattgaatatagtttcccatatgtgtctttgtatgccttactttctgtttttggaggaaagtccgtattaggagttactcggcgaatagcgcatcggttgtgtcctttcaggattgagtggtgtagattacttgcttcgccgagggtgtgatggaattcttggtttcaggccttaattgtgcgtggctggcgatttggatcataatgagcttgagttacagttctttcgcttgagccaatatcacgatttgggcatattcaggtcgtttcttactagcgcatgcattatacgagttgtggcttaggcctgtgttgagatgtcataccaccaaagtggcatgttggattagaagtgatcgttgggggtcattaatgaacacgagcggagtcggcttcagcctgttggaagatttatatcgaggtccggcttgggaatttattgtggtagtagtaaaaagggaaatgacttcataaatggttgatttgaggaattgttacagcctaattgcgtgtttcgtttatcgttggcagtatatgaaggtgttggaatgagatttaagacggtaagaggtttctaccggtattcgggtgttgtgagcaactgatatggatagaagttatcgtttcgagcgtatgggctatgtagtgtatcacatgatttcacctgaggttacaggcatgggctattatagctggttaggcttgtcctgagtatagaagtgaggttctgatcttgtgcaagatttcagaaaaaaaaaataaaaaaaaaatacaatgtgtttctacgacctgtggtctaaatggactgtgaaatttcagttgtgttgtattatcagacccatgtgggatatggtgacgtgggatcaccctggttatatgcttggtaagatcattcagctattggttggcttctagaacaaccctggatacgctcgaggacgagcgtttgtttaagttggggaggatgtgacgacccgacccgtcatctcatgtatttccgtcccgttttccccgttatatgcttactcatatttcaatatgtgtacttggtgaatttgagtcaattcggatcgagtttggtaggaaatgagacaattagtctctttaaggaagaattagtttggaaaagtcaatcggatgttgacttgtgagtgagagggctcggaattgagttccgatgattcggttagtttcgggggatgatttaaggcttaggagcgcaatcagaatgaattttggaggtccggtgtgaaagttagcctattttggcgaagttagaatttcggatggattcgcacaaggctccgctttaaaagagcacatctaattatgtataaggttttatgtggtaaatagcatatcaaatgaaaggtctttgagtctagtttccaacgcttcaagccgttcgtcattcggacattcctacacaaagttatgatcaaattaccaaatgcagcgaagaattttgcactaccgcgtagcggccccgcggcgcgccaccgcggcgcgccagtgcaagttatcagagacatccaatttcgttccagaaagcatttttgcactatcgtgtagcggccccgcggcgcggcagttcaaaaatgggtttttaagacccgaaccccatttcatttaactcgacttagggttcatttttgggtatttttctggcgttttagagagaggggagagcgttttagagagagaaagaagcataagtttcatggttcatcaaatcttgtacaaaccttgaaatctctcaagttcttcagcaaagaggtgagaatttctctttccccagctttgagaacctttggagcaaaaaggaagagggaatcgaagggaatttgatcggaggtaagtttcttgactcaataacatcatttaatcatggttttagcccttaaatttctgaaatcaaatcaaattgggaaagaactagggcttgaaatttcaaatgaagatttgcgatttggaggagtaattggaatccgattttgatgaactttatatgtacggactcgtggcgagacgaggaatccgttggtatgattttcggaatttttcgagaagtgggcccggggctcgggttttaccaacttcgtgaattttgatgcttttcgagtatttttgattgggttaaccttatttagcacatatttatgtaatcgtggtggttttgactaggttcgatgcgcgaagagggcgattcgagaggaaaaggcatcgcggaccagtccacggccagttagaggtgagtagtggggatagatgatggcctgagggtttgaaaccccgttttagcacatcgtgacgctatgttagggcgtgactcgcactccatggcaagtgcggggttggttatgactggggattgagacttagtccatcccgaataagaattatattatattggcgactgaaacgcaccctatatttattatatctgggcttaatgccatgtttggggccttatgccgatctgtagcatccccctaggatgtatattattgtgatagcatgatttgcttaatcatttgatctcagtcctgtgtttaatcattgatatgaaatgctaagtcaccttttttttttctgaaagttagtcaactaaatgatattttcctaataattggaaccgagaacttaattaaatctattatgtgactcatatgcatattatggactgagtatgggacgggctgcacgccgcagtaatgatatgatgatattgcgctcgggctgtaggagcccctccggagtctgtacacacccccagtgagcgcgggtacccagatggagcgggctgcacgccgcagtggtcatgtgcattgcattgcattcatgcatttacattctgtgatatatctgatgcttagaaaggtgtagaacggccagctttagctttaccttgtggtattgtgtggttttctcactttcgggtattatatatgcttactactcactgagttggtagactcaccccctactccctgtaccttgtgtgcagacccaggtgttccggagacttagctgagcagttgctgtctccagttgttccgagttgttgaggtagctgcctaacgttcgcaggacccgactgctcatcctttcagttgcttattttattccaaattaatatatatttctttattcagagattatttttagtcagttttagaggctctatactcgtgaccccagatcttttgggagtgttatgttagttttcgtattattctatactgattattggattattattttaaactaaagcattctttcttaaattgttggttattgagattaaatgttgatttgtaagtgagtgttggtcaggcttgcctagccttacggccgggcgccatcatgaccgggtttgggtcgtgacacctatatgtccggtagtgtccctattagtggaaatagtgactggatggatacgtgatgagtatgatgtgaccgcgagatgagttcatatgatgtgaagtgatgaaaagatattgatgaaggtttcacctatttgagactccaagtatgttttagactcgttcgaggacgaacgtttgtttaagagggggaggatgtaacgacccgttctttcattttgagagttatagcctcgtttcccccatctatccttctttatgtattattcagctatattgagttggtaggtttgggttcggagtagttttggagtgaaatgaatacttagtcttttagttagaaagctaagttagaaaagtcaatcgaaagttgacttatgagtaaacgaattcggatttgaatttttatggttcgattagcttcgttaggtgattttagacttaggagtatgtccagaatgtaatttggaggtctgtggtagaattaggcgtgaattggcaaaagttggaagtttagaagttcttaggcctgaattcgaggttgatttggtcttttggtattgttttgggcgttctagagattcgactaagttcggtagtgatatatgacttcttaaaattattggttgaggtcacgagggcctcgggtgagtttcacataggtttgggttgtgtagcgctagtaattcttatgtttcgacgtcgtttcttcaagtataaataatatcatattgaacaaatgagcttcgatttctttttttattgaagcattagatccgtatagtaattacggacctgtagtaaaaggaatgatcgaatttggacattgtatgaagattttaggttgattttactaagaattaggttgccagatttttcagtttaattaactatttgcaagtattaaaacctacatatctcattcattataaggtcaaattgagaattcaaaaacctaacttgactagaatttcacaaggaatctattggagtcataaaatacgagtttcggggtcgtttggtacgagaaacgaggcagaatagctggaaaaatatatatatataaaattagggtttgttcattcgatcatattttgagttggggagctcagatttgggcgattttagaggcgattttcaccatatggattggggtaagtgttctctactcattttggttatatttcatgaatccatcatcatttttagaatataattgatgattttaaagtgaaattgagggagttagggtttgagttttggagagttttaaatgaggatttgagagaccaaacggagtccgattttgataaattttatatggttagactcgggagagaacgaggtttatgattctgctatttttgactaatttcgagacgtgggctcgggggccgggttttggccgatttcggattttggtatattttgtaatttttattgtggaattcgattctttagcacatgttgatgatactaatctgattatggttagatttagaacttttggagaccgagtccagagaagagggtatcccgaagtaggattttacgttgttgaggtaagtaacagttttcaatctggctttgagggtataaacccggagaaagtaatatcatatgattgtttggtagtgatatccatgctaggtgacgggcgtgtgggtttgaaccgcaagggattgagacttggtccgtcccgtgaggtctaatagctattatttgtgattatgtgtttacttgttgttgaacttgtttgtcttcatgttagagatcacgcttaggctttattcatgcttacattatttttactcagtcatgtttaactcagtctctaatattgctaatatgctgtgatacttgatgtgagctgtgttccctgatttgttgataatggtgaggctagtgagggagtaaggccgagggccaggttgtgaggatattaataccatagcgcgtgagttgtccgcgtagcatgtgagttaaccgtgcgggtccaggtattgataccatagcgcgtgagttgtccgcgtagcacgtgagttgaccgtgcagatccaggtattgatatggtagcacgtgagttgtccgtgcttagcgcttgggctttggaagcccctccggagtctgtacacacccctagtgagcgcagagtgtagagtgtcgagtgttgagtgctgagtgattgagtgacattgctgtgaagttgcatctacttttgttgttgttgcatttatctgttaaatttctttgtggtatttactgagttatagaatttacctgtttattcatgtttgtgtttttatatttttaaattgtgaaaataataattgcattatttttcttagctcgtcactactgctcagttccttagttaattctgtcactactgaggtggtagtactcatagtacaccctgcactttatgtgcagatccaggtgagttagagcgcggtgatcgttgacttcaggccggctatctaaggagattacaaggtagctgctagtgtccgcaggaccttgttactcattttgtcgtttcttcttttagacagtttatatttcttagttcatagttttagacgctcatgacttagtgacacctcgatatttggggctagcttccgtattttatattaattatattaagagttcatttagtttatgagaaattcaaatgttgaaaatattttattaaattcttataattgagttagtagtaatattttgggaataggcttgccttgtaacacaataggcatcatcacgaccatggttagattttgggtcgtgacaaaagcatagcaaaatattaaaataatagtgactaactaattttacactagggttttccaaaaagtggaggacaatgctaaagataacgggaacaggctgaaaaacttaaaggtgaggtttagatatttccttgagattctacctaagaatgatagggtaaatatactaatttgaacttttgtgtttatagtgcacaaattaaataaattatgattaactgatttattaaaataaaaattatcattaactaataagggcggaactatctcttactgaaccctattaaacccagtatgtcttatatatatggagtttagaattcaaaaacataaaataattacaatttcaaacctataaattttaaatttttgctccgcatataattattaatcatgatgatcaccttgtgtatactattgtgtattgtattgtgcccccttatggtagttactggtggatattattattgcatgccatttatttatgattttatgtttagatatatatttatgtgatttctgttggagttactaatgctcttttatttttgtttttcttttcctttcttgagccgagggtcgatcggaaacagcctctctgccctttcgggtaggggtaaggcctgtgtacgtattatcctccccagacctcactttgtgggactatactggatagttgttgttgattatcaccttaatttaaatctacattcaacacatgcacacttttattaatttggcataagtcataccgtaaattttgaattctgaaaaagagagtaagaattctaatatatggtcaaaattagtgacagctttgagcagcaagtttgccgctgattggcctgaaaatttcttaaattggtgaaaaggaaattgaacaacattctgaacctctttgtttttacctataatgagaagtgtagattaatgggtggagataattgcacgtattattattattattattattttctttttcttttccatcaatatatcaccgttcccaaccaaaagcttttttggaaacaatctacctatcttcacatggtagggataacgtctgcgtacacactatcctttccagacatcacaatataaaataatatacgattattttatctcgcgtttaattgaatttttaaatccgtgattagctattccagaattaattgatcccacaattgggtattattctatcccactttatgggttggataataatttgaggattaattgatcctgaaattaatataaaacgacaaagatgcgcttctcttaggatcttacccaaagttttttaaacaattcaaggttaaaactataaataaaagtttatttcaacttatttggaatatacccgtgtatccgtttttagttcaataaatcattcatcttctaataaaatatattaactaaataatttcgtctttatttaattttcgtattaaattatcacattcgatgttttgtgtgataagaatgttccaccaaaatttaaaagtaagttctacagagcagtggttagaccgattatgttatatgcgacggagtgttggctagtcaagcacttccatgtccaaaagatgaaggctgaaatgaggatgtcgagatggatgtgcgagcataccgggttagatagaattaaaaatgaagttattcaagaaaaggtgggcgtggcccttgtgaagaacaagatgtgggaggcaagatttagatggttcggggatgtgaacatgagaggcacagatgcaccggtgaagaggtgttagaggttagccctagagggcctaaggagaggtataggcaggccgaagaagtattcaggagaggtgattaggcaagatgtggggctgatcaagcttactaaggatataaccattgatatgaatgtaacgacccgggcggtcgtttttagaatttgcaccccattcccccgttaaccgcttttcctaagtttatttatgctattttggtttgtcgggatgttcggtagttgaatccggagtgttttgggacaaatagtccctattcgagagcttaagtattgaaaaagggtccgtagtcggaacagtatcaagacgacctcggaacggaaatccgatggttccgttagctccattaggtgatttcggggttgggagcatgcccggaatacgttttggatgttcgtagctcaattaaccgcgaaatgccgaaagttgaaaattcgaagtattcgattgattggtgagaattggatccgagggtcggactgaaattccgagagtggcagtagcttcgttaggtgaatttggatgtgtgtgcaaactttcaggtcattcggacctcgtttggttagtttcggcatcagatatgattttgggaagttaagtttaacttcgagttgaattcaatgattttggtgatgtttgatgttaaagatagcgtttttatagcccgagcaagtttgaatgaagtattagagtatgttcgtaggtttggttgaggtcccgggggcctcgggtatgtttcggaggttcgacgaatttattttggaagttggaaagaaagttgcagcaggcttttgctatttccgctttcgcggaagaagggccgcataagcggactccgcggacccggcttgtgggtcgcagaagcggattgggaccgcaggagcgggctgaggctcgcgtaagcggcgaccgctgaagcggtcatctagcagcaaaagcggtcgctggacaaatgaaggaaaaccgcagaagcggtggtctgaccgcataagtggtgaccgcggacgcggtaaaaggaccgctgaagcgaaaatcacaatagaaaaaggggttttatccgaggcttaagttcataagttgaaaaatcaaattttagctcagaccaaggcgattttgggaggatttccaataggagattattgggtaatgtttctatgatcatttctagcttaaatccattacctagttgctaaattcatcttttaaattcaaattgaggtccaaaaatggaggaaatgggtgaaagttcattggctaatcaattggggttttgagggggcatttggcctccgatttgggaaatttttatatggttagactcgtgagagtgcgaggtttctgaaaatataaaaattatctgattccgggacattggcctgaggagcgttttggtcattttacctattttcgcgccgtagcttcaattttattagtgtaattagttaattgcgatgttatttacataatgtaactggtttgaatagattcgggccattcggcattggatactcgtggcaagggcttcacatcgtattgatttggtaccggttcgatgtaagtagcttgtttaaccttgcgtgggggaccttttcccttaggatttgattgttgttgatttaaacgccttgtgtgcgaggtgacgggcgtacacttgtgctgattattgaaaatccaccttacttgaaattcttatactgtgtttcctcgcttattcgactgctataaaatgctagttcaatctgtgatagatagagaagcatgtttagatataattaactgctcagtagcttattttgcccttattgtgatacgtgcagcatgttaggctagtttaccctatctgttggtagttcatattcaatccctgtatattcttggttgtgtttgcgcatttaatttgggactacggatgtgggattccggtagatcccctttattgtttattttgggactacggatgtgggattccggtagctccccttgcacttgaaaagttggactacgagacagtatcccgggagatccttcggataaatagatatgatggactacgggacggtattccgggagatccactgagacagttgggaaaaggaccacaggacggtatcctgggagatcctctgagtatttggccttgaattgtattctactgtgtagacttttggtttcacttggctgtttctttactcgtaatttccgttaaattgctgttatcccttatttagcttagttgttcagttatatattgcttctttctattctgttatgtttatctcggtagggcctcgaccttcctcgtcactacccaaccgaggttaggcttggcacttactgagtaccgctgtggtgtactcacgccacttctgcgcatgtttttcatgtgcagatctgtgacgacccaatggggtcatcaccgtaatgctcctttgttccgtacttctgaggcctcgaaaacctcttgaaggggttgcctcgatttgcgtgcgcagttcgggcgcgaaaccggaagattttaatattacgaaaatagaattaagtgtttgaaatgatgaattttaagtacaatagtgatagagttgactccggtcaacattttgagtaatcgggcccgaaatcgggatttttcaatttctgaaaatccgtagtaaaatatgggacttgggcgtatgcccggaatcgaattccgaggtcccaggcccaagatatggaatttttgtgaaaattgtttctgaaattaattaaggaaaaatgaaaatggaaattttatttaaaagctatcgtatcggcgtcgtattttggttccgatgccggtacatgtcttacatatagtttaagtgtcatctgtgaagtttggtcgaaatcggacgttgttcggtgtgttgcgggcctagatatctaaattattagaagtttgaaggttgaaattaaaaatgtcgattttggggtttgattcgtttgaatccgtaagcttagggtcagctctaacctatacacctgatttgctttacatttcattaaccataggactacattcctaatccatacacctatctttacatctcaaaaaccattggacaaaaccctaaccctaagaactaaaccctatagctaaggaaaagattatcagcagtccctaaagcagccatcacgtccagttcgacaatctcccttctccctcacagaccttcgatttctcagctcgagcagtatcaatggagctgctgttggtccgaccctagcaacagctgatcgactccctatcgattcgcgcagcagctcgccttcagttcctcgtcgagcagctgttggcctccttcgaacttccagcttgagcagcagctggtgatgtttccatcttgatcgagcagctgccggtctttcttttctcgttcaagctcaagcagctggcctccttcgttcaaaggtcgacctgctgcgattccgtcacgacccaagtagctgctgttggttttctcctccttcgttcccaagcaagcagctgctgtgacctcccttctcgttcaagagcaagctgttgtcgttatttttttttctcgattccagcttcccctgtaagtagctcttcacgttgatttccttttgtattagctggtctcgttggcttcctcgttaatgtctgttgtatttatggttcacggcgttgggttgtagttcgtttctttgttctttaatgatgagattagcaatatttttttgaataatggaagaaaggaactgaaatgctatggtaggtctattaatactattaaaatcaattagaggatatgaaaatccattaatgtattcatccctctggtagcggaaaaccactgtaggcttcttaacaaaattatgaaatggaattttagcacttatgtgctattgtataggtggctgtggtatttaattaactagaaacttaatgattctcaaggtcattatacaaagtttgtatgctaatatccattaattatattgaatccaattatggctagatatcgtggtttcggagtcggattctagagggaaggcgactttagagctttgaattgctagttcggcatcgaggtaagtgtttgttctaactctagttcgagggattaggactaggatattatttgctatgtgatacatgggtcggtgtataggtttggtgacggttacctatgcacccgagtcaaagcatgatcgtgggtctttaattgaaaattgttgaaagctatggcatgaaccctagctatcactactagaaattcaggaaaaatggaccccaaaaagagaccaaacttggtcccttttaggccaaatagagaccaaaaagcgaccaaacacgtctggtagcaaatttttcggtcccttttatttagggaccaaagttggtctctaattagagaccacgtttggtctctacgctcaatgaaccaaatattttggatattgactttagagaccaactttggtccctttattaatttaataatataaatttagctaccaaagttggtctctaaatataaaatccgttatttatttatttattattaatcattaataagagaccaactttggtctctaatccaaatattaaattttaaaatccggaaaaatagagaccaagattggtctcttatttattcaattatttatttattttattaaaatagagaccaactttggtcccttaatatataaatttaatttattttttaaacattagagaccaacctcggtctccatattaccagaaattttatttttttaatgacatagagaccaannnnnnnnnnagttggactattattgatgttgggatcgtgtggcacgccgtccacttatatattatgaaatgggatcgggtggtacgcctaccacaagatatattgaaatgggagcgggtggtacgcctaccacaagatatattgaaatgggagcgggtggtacgcgtcactacctcgtgagccggggttaggccaggcacttaccagcacatggggtcgaattgtgctgatactacacttctgtgcccttttgtgcacagatccgggagcagctttcggagcgcatcagcagtagacgaggagccagccttcagtccagagactgtgaggtagttcactggcgtccgtggaccttccagtcttttccttagcagttctagtttgttttatcagctcagacagactctattatgtatttcttctcagacctttatttgtagtgactcttagaaggccgtatgctgtgacactgttcttgggtagaggctttgtatcagattttcttccgcatttatttttatgagactaattaaagtcttccgcttgttttatgtcttttaaattataaattgttaattataaatgctaagtgtatgttggttcggcttgcctagctccgacagtaggcgccatcacgacacccgttggtgggaaaatccgggtcgtgacaagttggtatcagagcactaggttacttgagtctcacagcttacggacaaactcggtagagtctgagggagcggtacggagacgtctgtacttgttccccagaagctacagagttaggaaaatctcccttcgttcatttctgtcgtgcgattccgtttctcgagattgattgtctttctactctgttccttcgcagatggcgagaactcgagcttcctcttcttctgatcagcagcccgaggccccagcagcagctccagctaggggcagagggcgaggccgcgctagaggccgtggtaggggcagagctcagccccgagcagcagcacccgtggcggagcctcagattgatgttgaggaggttccagcctcagctgtgcctatggttattccgggtcttcaggaggccctagctcagattatgtcggcttgctctggcctagcccaggtagtctcagccaccgctgcagcagccacttcacagatagggggaggtaatcagacccccgttgctcgcacaccagaaccagtggcacatggattacagactccagaggcaccaccagtacagcagggtgccccagctccttcagttgtgccagtacagacagttgttgcgggccagactagtgatggtgcggcgatgtccgcgaattctttgcatgagactcagtttattgatcttgcacgccatgctgatgtgatactccccaccgagagagagagggtgcggaggtttgttgatgggttggttcagccgatccgtgctcagatggccatgagtgtcgggagtgagaatacattccaggaggcggcagattgtgcccgccgggtcgagttggcaatttctcaaagaggtggtcgcgggtctgacaagaggccccgacattctggtagattcagtggtacctcgtctggagttagggattcttatggtagaggccattcttctgggtcttttcagtcagcttctcaggcttcttgcggttcttcaggtggtcgtgattttcagtcgcagtatcttgaccagcagctttccagttcaccatcagcacctatcagagcaccaccgcttcgttattctcagcagccgagggcttgcttcacttgcggcgatatgaggcacatcgctaagttttgccctcgagcttccagtagctctcagcagcagggaccccgtcccgcgattcaggcaccagttgccccacagcctgcccagccagttagaggtggaggcagaggtcttagaggtggagctcaggctgccggaggtaggggccagccagaggttgagtcgtcaggtgcagggatttcaggtactattctggtctgtgatagagatgcttcagtattatttgatcctggatccacgtattcctatgtgttgtcacactttgcaccttatttggttatgcctagtgaggccttgggtattcctgttcatatatctactccagtggggaattctacagtagtggatcgggttcatcgctcgtgtgttgtggtattcaggggtcttgagacccgtgtcgacttattattattggatatggtggatttcgacgtcattctagggatggattggttgcctccttatcatgcgatcttggattgtcatgccaagaccgtgaccttggcgttgccggatatgccccgattagagtggagagggacccctggtcataccactcgcatcgttatttcttatgtgaagactcgacgtatggtcgagaaggggtgtttagcttatttggcttatgttcgcgactccagcgctgaggtcccgtctattgattctgtccccattgttcgggagttccccgaggttttcccttctgatttgccgggcatgccgcccgacagggacatcgatttctgtattgatctggcgccgggcactcagcccatttctatcccgccttatcgaatggcgccgccagagttggaaagagttaaaggatcagcttcaggacttgcttgggaagggcttcattaggccctgtgtttcgccgtggggcgctccagttctatttgtgaagaagaaagatggttctatgagaatgtgcattgactaccggcagttgaacaaggtaacgattaagaacaagtatccactgccgaggatcgacgatttatttgatcaacttcagggttcgaaggtattctccaagatagatttgagatccggttgtcatcagttgaggattagggcgtctgatgtccctaagacagcattccgtactcgctatggtcactacgagttcctggtcatgtcatttgggctgactaatgccccagctgcgtttatggagttgatgaacagagtattcaggccttatctggacttatatgtgatagtcttcattgatgacattcttatatactcccgcagtcaggaggagcacgagcagcacctcagagtggttcttcagactctgaaggatagtcagttgtatgccaagttttctaagtgcgagttttggttgagttcagtagcattcttgggtcatattgtttcagcagagggtattcaggtagacccgaagaagattgaggcagtcaagaactggcctcgaccagcttcagctacagagattcggagcttcctgggattagctggttattttagacggttcgtcgaggggttttcatccatagcatcccctatgaccagattgacccagaagggtgccttattcaggtggtcagacaagtgtgaggcgagctttcagaaactcaagacagcattgaccacggcaccgattttagtgttgcctacaggttcagggccttacacggtttattgcgatgcttcacgtattgggattggtgcagttctgatgcagaatggcaaagttattgcatatgcttcaaggcagttgaagatccacgagaagaattatccagttcatgaccttgagttagcagctattgttcatgccttaaagatttggaggcattacctatatggtgtgacgtgtgaggtttacactgatcacaagagtcttcagtatctgttcaagcagaaggagttgaatatgaggcagagaaggtggttagagttgttgaaagattatgatgttactattctatatcatccggggaaggccaatgcagtggccgatgcattgagtaggaagtcggctagcatgggtagtcttgctttcattccagttggtcagagaccgcttgccttggatgttcaggctttggccaatcgttttgttagattggatatttctgagcccagcagagttttggcttgcacggttgcccgttcttccctatttgagcgtatttgcgagcttcagtttcatgatccccatttatgtgtcctgcgagacacggttcagtgaggaggtgccaagaaagtgaatttgggggatgatggtgtgttgagattgcaggggcgagtttgtgtgcccgatgttgatggtattcgtgatttgatcttagcggaggcccacagttctcggtattctattcacccgggcgccgcgaagatgtatcaggattggagacagcattattggtggcgtaggatgaagaaggatatagttgcgtatgtcgctcggtgttggaactgtcagcaggtgaagtatgagcatcagagacctggtgatctatttcagaggattgagcttcccgagtggaagtgggagaggattactatggactttgttactggcctcccgatgactcggaggcagtgtgattcggtttgggttattgtggataggctgactaagtcagcgcactgcattccagttgctactacctactcgtcccagagattagctgagatttacatcagggagatagttcgtcttcatggagtgcccgtatctatcatttcggatcgaggtccgcagtttacttcgcatttctggacagccttgcatggagagttgggcactccggttcagatgagcacagcgtttcatccacagacggacggtcagtccgagcggacgattcagattcttgaggatatgcttcgagcctgtgtcattgactttggaggctcgtgggaccagtttttgccattagcagagtttgcctacaacaatagttatcagtccagcattcagatggctccttatgaggcattgtacggtaggcggtgcaggtcccctgtcggatggttcgagccgggagaggctcggttattgggtgtagatatggttcaggaggccttggataaggtcaagatcattcaggacaaacttcgtacagctcagtctaggcagaagagttatgcagaccgcaaggtcagagatgttgctttcatggttggagagcgagtattgctccgtgcgtcgcctatgaagggcgtgatgagatttgggaagaagggcaagctcagccctaggttcattggtccgtttgagattctagagcgagtgggagaggtggcctatagacttgctttgccacctagtttatcagcggtgcatctagttttccatgtatccatgctccggaagtatcacggcgatccatcgcacgtattagatttcagcactgtccaattggacaaggatctgtcttatgaggaggagccggtggccattctagaccggcaggttcgacagttgaggtcgaagagtttcccttcagtgcgtgttcagtggagaggtcagcctcctgaggcttcgacctgggagtccgagtccgatatgcgtagccgctatcctcatctattccccgactcaggtatttctttcttttgtccgttcgaggacgaacagttgttttagaggtggagattgtgacgacccaatggggtcatcaccgtaatgctcctttgttccgtacttctgaggcctcgaaaacctcttgaaggggttgcctcgatttgcgtgcgcagttcgggcgcgaagccggaagattttaatattacgaaaatagaattaagtgtttgaaatgatgaattttaagtacaatagtgatagagttgactccggtcaacattttgagtaatcgggcccgaaatcgggatttttcaatttctgaaaatccgtagtaaaatatgggacttgggcgtatgcccggaatcgaattccgaggtcccaggcccaagatatggaatttttgtgaaaattgtttctgaaattaattaaggaaaaatgaaaatggaaattttatttaaaagctatcgtatcggcgtcgtattttggttccgatgccggtacatgtcttacatatagtttaagtgtcatctgtgaagtttggtcgaaatcggacgttgttcggtgtgttgcgggcctagatatctaaattattagaagtttgaaggttgaaattaaaaatgtcgattttggggtttgattcgtttgaatccgtaagcttagggtcagctctaacctatacacctgatttgctttacatttcattaaccataggactacattcctaatccatacacctatctttacatctcaaaaaccattggacaaaaccctaaccctaagaactaaaccctatagctaaggaaaagattatcagcagtccctaaagcagccatcacgtccagttcgacaatctcccttctccctcacagaccttcgatttctcagctcgagcagtatcaatggagctgctgttggtccgaccctagcaacagctgatcgactccctatcgattcgcgcagcagctcgccttcagttcctcgtcgagcagctgttggcctccttcgaacttccagcttgagcagcagctggtgatgtttccatcttgatcgagcagctgccggtctttcttttctcgttcaagctcaagcagctggcctccttcgttcaaaggtcgacctgctgcgattccgtcacgacccaagtagctgctgttggttttctcctccttcgttcccaagcaagcagctgctgtgacctcccttctcgttcaagagcaagctgttgtcgttatttttttttctcgattccagcttcccctgtaagtagctcttcacgttgatttccttttgtattagctggtctcgttggcttcctcgttaatgtctgttgtatttatggttcacggcgttgggttgtagttcgtttctttgttctttaatgatgagattagcaatatttttttgaataatggaagaaaggaactgaaatgctatggtaggtctattaatactattaaaatcaattagaggatatgaaaatccattaatgtattcatccctctggtagcggaaaaccactgtaggcttcttaacaaaattatgaaatggaattttagcacttatgtgctattgtataggtggctgtggtatttaattaactagaaacttaatgattctcaaggtcattatacaaagtttgtatgctaatatccattaattatattgaatccaattatggctagatatcgtggtttcggagtcggattctagagggaaggcgactttagagctttgaattgctagttcggcatcgaggtaagtgtttgttctaactctagttcgagggattaggactaggatattatttgctatgtgatacatgggtcggtgtataggtttggtgacggttacctatgcacccgagtcaaagcatgaccgtgggtctttaattgaaaattgttgaaagctatgtcatgaatcctagctattgaattaatccttataactaattgttggaatcaaatgaattaaatgacttagttggatagttcgggtgaaatgctttgccgaataatgtggaactctatgtgattcttgtgtcccttgccgggattgtttggttatagctgcacccttgccgggttagatgagttatgtaaattgttgtgctccttgggataggacttatataaaatttgaataaagttggactattattgatgttgggatcgtgtggcacgccgtccacttatatattatgaaatgggatcgggtggtacgcctaccacaagatatattgaaatgggagcgggtggtacgcctaccacaagatatattgaaatgggatcgggtggtacgcctaccacaagatatattgaaatgggagcgggtggtacgcctaccacaagatatattgaaatgggagcgggtggtacgcctaccacaaggtatattgaaatgggagcgggtggtacgcctaccacaagatatattgaaatgggagcgggtggtacgcctaccacaagatatattgaacatggaaattgggatcgtgtggcgcccgtccactttgtacttactgttttacttacattggtcatagattaactgcttagcttgttgtactttatgctttagaactgttccccttacagcatgtcccctcccgtacttgtttattttatatattatttcctgtttcgtatgcatatatatcttgcacaggttaacgctgtaggtccggtctagcctcgtcactacctcgtgagccggggttaggccaggcacttaccagcacatggggtcgaattgtgctgatactacacttctgtgcccttttgtgcacagatccgggagcagctttcggagcgcatcagcagtagacgaggagccagccttcagtccagagactgtgaggtagttcactggcgtccgtggaccttccagtcttttccttagcagttctagtttgttttatcagctcagacagactctattatgtatttcttctcagacctttatttgtagtgactcttagaaggccgtatgctgtgacactgttcttgggtagaggctttgtatcagattttcttccgcatttatttttatgagattaattaaagtcttccgcttgttttatgtcttttaaattataaattgttaattataaatgctaagtgtatgttggttcggcttgcctagctccgacagtaggcgccatcacgacacccgttggtgggaaaatccgggtcgtgacaagatccaggtacttctacacaggcgcattatcagtagctgcagggagcgtttcagagacttgaggtattcatctgccgcgtccgcagatccgcaaagtctcccttttattctatccatagtattagatgttattccatcctctctttgtattagactattctggtgactagagtattgtacgaatcttatagcctgtgttgcccgtgagttttcggattttgggagttgttttaaattatcatcagtaaagtgtatgagccacgcgacgttttatatatttctcttgcttctttcagaaattattatttacttttcataatggttgttggattccgcaatgagttaggcttacctggtctagccgaccaggtgccatcatgacatgttcacggacgatgaactaaggtcgtgacaatgaaggtatggatgttgaaaattattagagagttaagacatgctgtggagcgttgtccttatctgtaaaagcagctttagtatgtgatttgatattattttatgtattctcgtattccttgactccagtgattacttgttattgctttcgtgtcggctttcatattaaagtacctagtgaatttaattttttatttttgcttcggttttctaattggtacgtttgttgttgccattccttttacctatgctaatccgtacgtctttcgaaggtagggaaaagacatgcgtataacctcccgagactccacttatgagattactttcaatttttattgttgttgttgttgtagtattaaattatctcatcattggctaataaattatctcaaaatttcattggacttttgtacgaggtaggtgtcaatatattcaattattcttcattgaactatataagtggaatttatgggagagaagatgacaaaattacaatctcaaacctatttgaaagagtggccgggggaaaccccaaaatttccgtacgacagtaaaaagagctgtcaaattgggatgcggacaatgatgagattttttgcccaatctttttgtaaaagtgaaactacctcttttctgaatatctttttacgaagtcagccaaaccaaaacttggaaatgcttttgtttatttagtaacaaattaataaattttactaagcataacaaaatattaaaataatagtgactaactaatttttgtttagacatgttatcagaattcaaactttagaaaattatggaagaatagacgtcaaaacaatccatatgagtgtcgtatatactactccctccgttttaatttatgtgaactcatttgactgggcacgaaatttaagaaaagaaagaagacttttgaacttgttgtataaaatgaggcacatatattttgtgtgactataaatcattgcataaaggtaaattgtttccaaataagaaaatgggtcattcttttttgtacggacgaaaaaaaaaataggttcacataaattgaacctgagtttacagtcatttccctatatatagacaccattcccccctctctctccttctactatccttctctcccttctctctgtcactatcacttccaaagaaaaatggtgaagaaaagaattatgctttcactctttgttttgttttacctcatgagtatttgcatgttgtttcttgatggagctttggctgaacaaaaataccccaattggagctacgctggtgttgtgctgatgatttctatttgctgtgcagtttcattatttcctcctgaggttaaggtcccaatagtgaagggtccaggcataatttctgccaagttgttgaatcctattgggcctctggtggctatgattgtggctattatgctgagcttcagagggcctagtacatggttgtatagatttttccatacaagtgctttcttttacactatgtaccttattccggtgtttctaccctttgtgtgggatggcggtgagcatgtcagttagggattacggctgctcaggagacacatgggtcactattactatttgtgtataacgactcgaccggtcattttgagctctagcacgtcgttaggcagttagaagtttttgcagctgatgcctattagtgaggttttttatggttctagtagtttcattaatgggttttggcctttcatggtttgtatgaatgatatttccaactatttgaatgatagatctagctttgtttctggaaatactctcatgatatttgcttattagctttcttactatttgaatgataaatacactatgtaccttattccttaaaattggtttatggtagtttttgggcgtaattttttcttccactcataaaactttaattttttttcaaataaaatgtatgtccaaacacaacttcatttgacaaaattatttttcagcacaactttaaaaactattttatcaagtttcaatcatatttatgttcaaacgctagctaaatcaattatttcctttaacttttatttttttgccttcaaatttcaattaaatgatgtccaaacagtaacaataatacccaatttaaactccaaatactgattttttttaattctatttttaaatatcaactatatctacttttgggcatagaagaaaaagaaaagacaaaggactatgccagcactcttttatttattttttaattattcaaaggatcaattaaattctccgtctcctgaaatcctttaaaggcaaattttgttaattcgaaaggtggtagctatacaaattatagtcattattaatagtagcttctaaatacattatgttacagatgaactatattcctattagagtcaaatatctttataacaatcttgtttgttctgaatatttttgactgttataacaaattgttgttaaataaagaatatattataacataacataaaaattaatttaaaaaaagattgacttatataataaagtgttattatatagtgatatttttattgtgaggtacgtaaaataaagcaaaagcctttaaaagagaaaatgattaattaagaaggtggcgatagacttataataatagaacctgtttgtaaactagataataaaatggagaaatgtgtcaatagtttcacaatcttggcatataagaaatttgggtaatgatgacaaattattaccaacattacatacattcttccatttaatttagatgagatagtttattttggtacaaaaggaaatttttttttaaaaaaaatttatgatcttaaaagcttaataaataaaaaaatgtagggccatgacactagttataaaagcttctcataggtaagaagagtaaaatgaagattttaaaattgaattatttcaaaatatgaaaatatgtcatttattctgaaagaaactaaaaagaaaagcaatttatttaattgaaacggagggagttgtacctttaatagttataatacccgatttgacggctaagtgactctagacctccccaaccccgcacccggactttggaacccaattgtggttcttttggactcaaaatatcaaaatacatgaaaaaaaacttggtgatcaatgtatataaaacgtgcttttgaaccgcgttttaccctaacgtcccaaaatattttgactaagtatatacttacctagatatacaagatttgaaataccaaatctagaaaactaaagactcaaatctttctattgtattcttggatccacaattaatcctatggatccttaggattggtatattccactatgagaatttggatttttagtgtcaacatatagtggcgaccgtataggttgctacaatatttaaagtattagcagcgacattaaaggttgctacagaaggtgaatatttagcaacgacttttttgaggtcgcctctgatgtggctgaaattttcagtcccgcaaagaataaaattttggctccaaattatttgtggagacattaaacttatcgccgccaaagagtttttgcagcgattgagttgctactataccctagaaattttaatttaaaataacaaaacaaaattaaaaaatcctcttctttttctaattagaagaaacgaaccccggccctccagagttcagacacacaatgatacaaacataaccttcatctctctagaaatccctcccccttctctctaaaatcatatctgtgctaaaatttgcatgacccagctctaaatctctctaatcaaaatgtgaattgggtatgtgttcaaattcctaatcttttcctttttcttttaggaacgaaaatttcatctaggtgctattcaatctacgattttgtggtggaagaagtaaagagacctaaggggtccaaagctaactctaggtcttacgtgcttttgtagcccaagaaacaaataaactctacttagccagctgctatttcatcatattcaaaattttgaatgaagctttttttttttcttttaataataaagtcacatttgtcatccattttggcaagagacaagagaacccttttcttgtataagcacggaatacatatacatttttttcgttctgaacttgtgttcaacgataacgatgcgtatcttaccatatcttatgaaatatcaccagaagagttgaattttgtttgcttgcttcactagtacgcttatgaaaagaaggaaaacattcaaagtactcacctattgccctttaggattaattaagtattataaaaatgacatttgcttttatagtacttcgatagttcttgtccttcccttgcaccttgttatattctatgaaatatttgcttctttagagcaatttctaacattttgtgagtttacaataatggcatgaatgatatttactacttgcttctgtccaaattgtcaatgttgggaaaagtaaactagattcatccaatttacctagttcatgtattaggaaattagctaagatgcatgtttgaaagacatatttccctgtatgaatcagattgctctagaaaagcatttagagcatatcaatttaatactctttgagtctagttgggtaagagatgttaaatctgtttatcaataaggtgtttgtagatgtggcagtgtatatatttatttttatgaaactaatttatttccttgtaaccaaaaggtgagtaagagtagaaacttgctgcaatatttctcattttatttagaagtgatttgatttgtttatttctgatgtatgtccgttattatatatgttttgattattatcaacgctgcacttttatttaattaaatttcttttgtttaaatagaaaggatggataaaagttgattgaatattaaaaatagagtagaccaaaggtatagaaatggagtagacaactttcttaattgggcattcagtcaaccaacggtgagcactatgattcgatgtccttgtaaagggtgtatgaataccgagttcaagctacggtttggtgtaagaggagatttattgaggaaaggattttgggattcttataaagtgtgggacttgcatggagaagtgtcagttagagttgaaacttctagtgttgtagttagtgaagatgaagcagaagatgataacattgaagaggacaatattagtgaaatgattcacgatatttgtggatatatgaatgtggaggataataataattcagaggacaacgaagagacaaatatacatgcaacaaagttctacaaattgttagaagatgctgagacaaaactttatcctggttgtgaaaaagtctcaaagttgtcttttgttgttaaactagttcacttgaagtgtcttaatcattggagcaacaaatctatggatgcactattgagcttctttaaagaatttcttcccgaggggtcatttgtgccaaattctttctatgaagcaaagaaagttctgtgtgacctcgacttggggtacacaaaaatagatgcatgtcgaaatgattgtattttgtattggcttgattatgccgatattcaagtatgtcctaagtgcggtaagtctagatggaagtccgaagaacacggaggcaagaaagtagctcataaaatcttgcggcattttccaatcaaaccaagacttcaaagattgtacatggcaagagagacagctaaaaagatgaggtggcacaaggaggaaaatgttgatgatggtgtcttgcgatatccgtctaactcaatagcatggaaatcctttgatgcataacatcccaccttttcgcccaagttaagaaatgttcgactaggcttggcgagtgatgggttccaaccttataggaacatgagttctattcatagtatttggccagtcgtactagctacgtataatttgccaccatgggattgtatgaaaaattcctattttatgctgacacttcttattccaggccccaagtgtccgggcaatgatattgatgtatatttacaaccaatgactgaagagttgaaagaattatgggtcggggtggatacttatgatgcacactcaaagtctaattttttgatacgtgtggctatcatgtggacgatcaatgtcacgatccgaatttttcaccatcgggagtcgtgatgacgcctactaataggagctaggcaagccaactcttacttatatttccatttttaacaacacttattttaaaacagttagcaataaataatacgattactgtggaataaataaatggcagaagacttagtaaattttactagatgcgatactggaatccaaacataaaacactacccaagaaatggtgtcacaatactcacgaacttctaggaataatacacataaccgtccgaaagaaatataatattgtttgtctcgaatacatgagataacagactgaaaactaaagatacaggagacgtcgggtcctgcggacgcctgcaagactacctcggtgtctcaaatgatcgaaagttaacgctcgcactactgcctctgctgctgtccaaaacctgtatctgcgcaaaaagagcgcagagtgtagaatcagcacagccgaccccatgtgctggtaagtacccggcctatcccggcgaagtaagtgacaaggctaggactagacactcacataaacctgtacagttcaaaatacatacatacaacaaaatcacagaaaaaccaacatttaatatttaggaaggggaaaacatgctctggagtagcaacaaaatataatggcagaagtagaataaataaactgtaattaaggagaacgggtaaataaatatctgcacggtaccaaccatcgtgcttttactctcgttctcaccaatacagtcaaataaagtgtacgacatcaaccatcgtactttaacactcttcctcatccaatcaataatatgaagtaattcaatggttacacggcatcatccatcgtgctttatcactcttccttacccaatcaataatataaagcaaatcagtgattacacgacatcattcatcgtgctttgtcactcatcctcacccaagcaacaaacaatggggcgagggaataaacagatagtattaaatatcccaaataagggagaataccataatcacagtcaatacgtcccagcaagagaacaattatttctctttttcttttattcacttcttactcaattctcagatcatcattcgaaccaacgctccagagaatttatcattttataatttccttctcacacttattacattatgtagaaatcaacaattaagtgtggaaaagttacatcaatatcaaataatcattagtaaagactcacggtcatgctagacccccaacatatagatacttgtcaccatgcctatacgtcggactccgcacgtagcaatttgcaaatagactcaacttctattccctcaagctaggatagatcaaacacttacctcgaaagtttatggcaaactcaatccttaagcaatgccttttcctttcaaatttggctccaattcaatcgtatctatacataattgatttaatatcatcaatactactcaacaaaataatccaaatggctaaatatatattttacaacattctacccggaatagtgaaaatcgaccccgggccaacgtggtcaatacacgaggttcgaacaaattttcgacaacccattcatccacgatttcaaatatacaatttgttcttaagttcgatcccaaaacaaggtctaagtcacaaattatttgaaaaccctaactatacccaattctctaattttctacctattttcacatgtttaggcctaagaatttgattgatgttgatgagaaatgaagacaatgagttaaacaatacttaaccaagaagtttgatgaagaatcgccccaaaatcgcccaaagtagctgttgaagaagagggagtttgagaaatgggatgaaaatcccgtttctgttctgtttttgggtctttaaggcattggacggaatttgctctatgcgatcgcagggcctgggatgcgatcgcatagaagaaaagaaggggggctgaactttgctctatgcgatcgcggagaagtaatgtgatcgcatagaaggaatcctgggcctcaatatttactctatgcaatcgcgtaggagtaatgcgatcgcatagaaggatttcctcgacctcaagatttactctatgcgatcgcatagaacaaactgatgactaccaaattaactctatacgatcgcggaagaaccaatgcgatcgcatagaacaaattagtgacttcccaattaactctatgccatcgcatagaacaaaaacctggacaccaacaaccagcaaaaacaccagattttctaagtccaaaacactccgacacctatccgaaactcacccgagccctcggggctccaaaccaaatatgcacactgactcaaaaatattatacggatttaaccgtgcgatcaaattgccaaaataacatcaagaacgatgaattaagagttaagatccaagaaatctttcaaattttgataaacttccaaattttccaatttaaggccgaaatacgtcaagcgacgtttgttttcaaccaaactttacaagaagcgcttaaccaacatatatgacctgcaccgggcatcgaaaccaaaatacgagcccgataccattagtttttgataaatttttattttcattttccttaaacattttcagaaaataatttcacagaaaaatttatttcttgggcctgggacctcggaattcgattccggacatacgcccaagtcccatatttttctatggaccttccgggaccatcaaatcacgggtccgggtccgtttaccaaaaatattgattaaagtcaactttaacaatattaatatcataattcttcaaatttttcacataattcatatatttcaacaaaaaaaatttccggcttcgcgcccggactgtgcacgcaaatcaaggtaactaataatgagattttcaaggcctcagaagctcgaaatgactataaaacaagtgatgactctttgggtcgtcacattctccacacctaaaacaatcgttcgtcctcgaacggacaaaagaaagaagtatctgtgtcaaggaatagctgaggataacggctccgcatatcagactcggactcccaagtcgatgcctcaggaggctgacctctccactgaacacgcacagaaggaaaactcttcgacctcaactgtcgaacctgccggtccaatatagctaccggttcctcctcataagactgatccttgtccaattggacagtgctcaaatctaacacgtgtgatggatcgtcgtggtatttccggagcatggatacatgaaacactggatgcatagctgacaaattaggtggcaaagcaagtctataagccacccttacaacacgatcaaggatctcgaatgggccaataaacctagggctaagcttgcccttcttcccaatctcatcatgcccttcataggcgatacacggagcaatacccgctcaccaatcatgaaagctaaatctctaaccttgcagtctgcataactcttctgcctggactgagttgtacgaagcctatcctgactaatcgtgaccttatctaaggcctcctgaactatatccgtacccaacaaccgagcgtctcttggctcaaaccatccaacaggagattgacaccgtctaccatacaaagcttcataaggagccatctgaatgctcgactgatatctgttattataagcaaactctgccaaaggcaggaactgatcccacgaacctccaaaatcaataacacaggctcggagcatatcctccaatatctgaatagtcctctcggactgaccgtctgtctggggatgaaatgttgtactcagctgagcctgggtgcccaacactttctgaaatgccttccagaaatgcgaggtaaactgcggacctcgatctgaaaagatagatataggcaccccatgaaggcaaataatctccctgatataaatcccttctaacctcttggacgagtaggtggtggcaacaggaacaaaatgtgctgacttggtcagtctatcaacaataacgcaaaccacatcaaacttcttccgagtcatcggaaggctagtaatgaagtccatagtgatccactcccacttccactcgggaagctcaatttttgaaataaaccactaggtctctgatgctcatatttaacctgttgacaattcaaacaccgcgctacatatatcacaatatccctttttcattctgcggcaccaataatattgccgcaaatcctgatacatctttactacgcctgggtgaatagaataccgggaactgtgagcttcttctaaaatcaattcccgaagcccatctacactggcacacaaattcgcccttgcaatctcaaaactccatcagcatctgaggtgacctgcttggcaccccctcgctgaaccatgtctttaaggacacataaatggcgatcatgaaactttcgattgcgaatacgctcaaataatgaagagcgagcgaccgtgcaagctagcacttgactaggctcagaaacatccaatctcacaaaatgattagctaaggtccgaacatccatagcaagcggcctctaactgaccgaaatataagcaagactgcccttactggctgacttcctgctcaaagcatcggccaccacatttgcctttctcggatgataaaaaaatggtgatatcataatctttcagcaattccaaccttcttctctgcctaaaattcaactccttcttttaaacaggtactgaaggcttttgtgatcagtgaatacttcacatgccacgccatacaaataatgcctccaaatcttcaatgcatgaacaatcgccgccaactccaagtcatgaactggatagttcttttcatgaatcttcaactacctcgaagcataggcaataaccttgccatcctgcatcaacactgcaccaagcccaatacgggaagcatcacaataaacagtatcaggtcctgaacctgggggcaaaaccaataccggtgttgtggtcaaggctgtcttgagcttctggaaactcgcctcgcattcatctgaccattcaaactggacactcttctgggtcaatctggtcatcggggttgcaatggatgaaaacccctccacgaatcgccgataataacctgctaatcccaagaaactctgcatctctgtggttgatgttggtctaggccagtttttgactgcctcaatcttccttgggtcaacctgaataccttttaccgtcacaacaagacccgggaatgcaactgaacttagccaaaattcacattttgaaaattttgcatatagctgactattcttcagattctgaagagcgattctgcggtgctgctcgtgctccccctggatgtgggagtataacaatatttcatcaatgaagattatcacgaacaagtctaaataaggcgtgaacactcggtcatcaaatccataagagctgttggggcatctgtcaactcaaaagacatgaccaggagtctcagctccatcatttcgcaccaaaactagatatgacagactactcctttcaaactacactaggaatgcaatcagtcacaccatgctactcgatccccggtacacccagcagagccaatgtaattgacttagcatgacattccataatagcatgacacggagataacaaatccatgcccaatataatgtcaagtacaccaggctcaatagccataaatcattttggtcccccagaccctttataaccgcaacacatgataggtacacacggtccacaacaccagtgtcgcccaccggggtacatacatgagcagataaagaagggaatctcccaaggcgtacccaattaatgagtaaaatatgaggacaaataagaagaggtgaaaccgggattgaatcatactgaggcatctctgtagtagactgatataatataactcttaaccgtgcaatcaacttgattattagcaaacttttcgacttggctcaaagccatggatcaaaacgcacttaacaatttataacgcataaactctattattgtcgtaagaccataatgaggttgaactcatccccttataagcttatggagacactatttatctgaaattataattcctctgaaatccttgcattttctcccacaatagttaagcccaatctctaggcgaccaatttactaagtacaaattttattttagaaaaatttagacagagtctcctttgtaattgggcctatccacctgtcagagaatcaccaaaactatcatacaagaatgatgaacccgatccaccactatagaatccctactagtgtagacacatgtacgggaatactaaaggcctcactaggcatagccaattagagtgcaaagatagaaagacacatatgcatacgtggatccaggatcaaatagcagtaaagaatttctaatacatatcaaaacggtacatgtaacgtctgcatctgaaatctcaacctccaaaatggttgctggctgatccctactgctggcggtctggactccacctctaagacctctaccttcgcctctagccggctgggtaggctgtgcaaccctcggtgcttgaagacaagcacgataatcctgatattgagagctgctcagagctctagggcaaaatatgacagtgtgcctcggatcaccacaagcatggcaaagccttatccgctgctgcaaagcacccctcaacctcggacagaccctcctgttgtgactatactcaccacactcataacacctacacatacgctgcaactgaggaaactgaggctggccctgtcgacctgaacgatcacctaaagtaccataagtgacgtggggagctgactgaaagggtctgaaaggatggcctctaccataaaaatctcgacctccagacgaggtaccactgaacatgcctgtatgacggggcctcttatctggcctacgaccgcctccttgtggtagaaccatctcaactccacggccgacctcactcccgacctgagctactgtacttggctgaccaaccatagctgcatgaacccctagaagcaaacccgctcgaatgacgctctccactaagccccccaatctgaccatagcatcctgaagaactggggtggctatgaacccctctaggacctgagctgggcccactggagctgttggggctgaaacttcctcctcgacctgaatctgaggctctgctactggtgttgctgctcggggctgagctctgcccctaccttggcctctagaacggccttgacctcggcctctgcccctagcgggagttgttgctggggcctcgggctgctggttagtagatgaggaagcgcgtgttcttaccatctatggaagaacagggtagaaatccaattaacatttgaagaacaaattcgcacgacaggaaagaataaagatgaaatttttcctaactctgtagcctctgggaatagatacagacgtctccataccgatctctcagactctaccgaggttgttcgtgagttgtgagacctatgtaacctagagctctgataccaacttgtcacgacccgaatttcccaccatcgggagtcgtgatgacgcctactaataggagctaggtaagccaactcttacttatatttccacttttagcaatacttattttaaaacagttagcaataaataatacgattactgtggaataaataaatagcggaagacttagtaaatcttactagatgcgatactggaatccaaacataaaaaactacccaagaacaggtgtcacaatactcacgaacttctaggaataatacacataaccgtctgaaagaaatataatactgtttgtctcgaatacatgagataacagactaaaaagtaaagatagaggagacgccaggtcctgcggacgcctgcaagactacctcggtgtctaaaatgatcaaaagttaacgctcgcactactgccgctgctgctgtccaaaacctgtatctgcgcaaaaagagcatagagtgtagaatcagcacaaccgaccccatgtgctggtaagtgtccggcctatctcggcgaagtaagtgacaaggctaggaccagacactcacataaacctgtacagttcaaaatacatacatacaacaaaatcacaggaaaaccaacatttaatatttgggaaggggaaaacatgctctggagtagcaacaaaatatattggcaggagtagaataaataaactttaattaaggagaacgggtaaataaatatctgcacggcaccaaccatcgtgcttttactctcgttctcaccaatacagtcaaataaagtgcacggcatcaaccatcgtactttaacactcttcctcatccaatcaataatatgaagtaattcaatggttacacggcatcatccatcgtgctttatcactcttccttacccaatcaataatataaagcaaatcagtggttacacagcatcatccatcgtgctttgtcactcatcctcacccaagcaacaatcacaaacaatggggcgagggaataaacaaataatattaaatatctcaaataaaggagaataccataatcacagtcaatacgtcccagcaagggaacaattatttctctttttcttttattcacttcttactcaattctcatatcatcattcgagccaacgctccaaggaatttatcattttataatttccttctcacacttatcatattatttagaaatcaacaattaagtgtggaagagttacatcaatattaaataatcacgagtaaagactcacggtcatgctagacccccaacatatagatacttgtcaccatgcctatacgtcggactccgcacatagcaattagcaaatagactcaactcctattccctcaagctaggatagatcaaacacttacctcgaacgtttacggcaaactcaatccttaagcaatgccttatcctttcaaatttggctccaattcaatcgtatctatacataattgatttaatatcatcaatactacccaacaaaataatccaaatggctaaatatatattttacaacattctgcccgaaatagtgaaaatcgaccccgggcccacgtggtcaaaacatgaggttcgaaccaatttccgacaacccattcatccacgagttcaaatatacaatttgttcttaagttggaccccaaaacgaggtctaaatcacaaattatttgaaaaccctaattatacccaattctctaattttctacctatttgcacatgtttaggcctatgaatttgattgatgttgatgagaaatgaataaaatgagttaaaaaatacttacccaagaagtttgatgaagaatcgccccaaaatcgcccacagtagctgttgaagaagagggagtttgagaaatgggatgaaagtcccgtttctgttctgtttttgggtctttaaggcactgggcggaatttgctctatgtgatcgcagggcctgggatgcgatcgcatagaagaaaagaatgggggctaaactttgctctatgctatcacgaagaagtaatgtgatcgcatagaaggaatccttggcctcaatatttactctatgcgatcgcgtaggcgtaatgcaatcgcatagaaggatttcctggacctcaagatttactctatgcgatcgtggaggagtaatgcgatcgcatagaacaaactgatgacttccaaattaactctatgcgatcgcggaagaaccaatgcgattgcatagaacaagttagtgacttcccaattaactctatgcgatcgcataaatacctatgctatcgcatagaacaaaaacgtggacaccagcaaccagcaaaaacaccagattttctaagtccaaaacactccgacacctatccgaaactcacccgagccctcgggcctccaaaccaaacatgcacactgactcaaaaacatcatacggacttaaccgtgcgatcaaatcgccaaaataacatcaagaacgatgaattaagcctttagatccaagatcatattgatggtgcgtgttggtgagggccgtgagaagttgagcttccctttgtcgctgagcaattctttcaggaacccttggtttaacatctgaaccacctcctgtcggagacctatacagtcttcggtcttgtgccctcgttcctgatggaactcacatagggcatttgattttctggtggtggggtcggacttcatcttcactggccattgtacattgttgcccagtttctctagggcgtacactacttctgaaggagacacacaaaagttatgtgcagataatgaaggaggcatacctctgtcattttgtagtggggcgacgtgtcgctgtaacgcgtccgtatgccttggtgggggcggatgtgaagatctgatgtatggttgatgcctttcccggttgaggcgtgggatctgttcccgtcgtccctcgttgcgccggtcccttcggatttcggggtgtattgtggttagtcgtcgggttggaccgttaaggtcgtcttcatctgcacgtacctcggtgcagtaggcctggtggattttctcccaggtggtggggggatactttatgaggcggctcatcagcttcttggttgccctcgagccatctctgctgagtccgttctgaaagttggcgactgccatgcattctgacacgtttggtaagctcattttgactcggttgaacctggccaggaagtccctgagccattttcctgaggtctgtcgaacaataaagatatcattaacacttgctcccgctttttttgcgcctgcatgggcggtgacaaatttgtccgccatctcttcgaacgtggagatgtttttggctggtaactgggaataccacgtgagggcccctcctgttagtgtttcgccgaacttcttcagaagcacggacggtacctgttccttcgatagatcgttacctttcacggccgtgacataatgaatccgatggtcttcggggtctgtggtcccatcatataccctcaagtaggggggcatcttggaggttttcggaatggagtatggtgcggctccttccgtataaggttgttcgacgaacctccccatgtcacgtttgggtaacagcttaggggcaccgggaatcttatccactctttcctggtgttctttcatctggtcgcgaagtgacttattttcattttccatttcctccaccttcttgaggatggctgcaagtgcaccgtcgttggcctgagtgtcggtgagcgcattgtccgctcgtacgacctcgagttcctcttcagctgcagcgagatctaccacttgcgtgcgtttgacattacttttcggtggtcttccgaccaggtcactcagagtgtctgtcaaccattctgccagttctttgacctctgggggtgcattcttagaggtagatgtggaagctcctttttcttgcggatccatcagatctctaggtggaggtgatggagttcccccactcagtatggtactaggggttgcgcttaggatattatacaaattacacgatttacaatacctctctaaaagttgataatcaatactaaactccatcaatattactcacattggagaattttgggaccacatgattttccctcgaatccttgtttcttgctcacaaaggcacataccctcctgcatgttgatatagttgtaaaattataatatctttgagatagactgatttgtgcatgctattaggtgttcaaagttcaaaagccaccctacattcttctctatttttcattattatcttgtttgatttgattatactctattgaattatttttaatatttttacaacaataacagtcattagtggcggatccaggagttttatcaagcaggttcaaaaaaaaataattaaaggtcatatgtaactagctagtttcgaacttaggaccatgtggaaaatttgaaccctctttgccaacaagctagatattttacttgttcgaagtgagttcaaaattatatttatagctttacttgtttgaaaactgcaaaaatatacctatatatacagtattatttttcggtaaagcgggttcatatgaacccacttgactccactatatatcgatatacatcgagattcaccgactattagggacggatctatatagggaagacggggtggtatgccactccgttgctcgggtagaattccggttactatagtattctacgaaaaaaaaagcttatataaatgaaggatggcaacctaagtaacaaattggctgtagcctgtaggtaccatggtcaaagttcttctcaccagtcccaagacctaatgcaaagcctattttctctctgtgtaataccaatttcattagttatttagaatacaaaagtatatttgcttatattttcttgtcctagatctcaaatttttttatttgaatatgcttttagttattatttttatctagttaatgttatttttttaaaaggaccaaacatttccagtttggttatcgagtatttatttatacaaaaaaaaacttgtaaagcaaactaaattaatttaaaataggttgaaccgaatcgaattaattcaaaacagagcaaaccgatctaatgtactccctaaatcaatctccttgactattgataaatttatattaaatacagtggcacccataatcattaaatcttggatccgcctatatatatatatatatatatatatatatatatatatatatatatatatatatatatatatatatatatgtatatatatatatatttgaaccattcagctactcctatatatcatatttttgcaagtataagagttttttcctttgtgttccgtgggagctattatagcgagttctactttttgaataaatgaattaaaagaataacaagaatattactagtagaattttcataattcctggagagatggtttactaacatatcgaagtaaaattaattcatttggtccattattcagatagaatttgctagacactccaataaattaaaatatttatttatcgagctcccttttcaatcttattaggtttaaataaaggcagaatagcctaaatggcacctgtactttgtccgttttgtcatgtcggtccccaaacttatatatatgccaattgaacacttatacccgttcaaaagatgaataataaacgcttacaagtgttcaattggcaatgcgtgtgttacaatagcctacatgttggatggcaattgaacacttgtaagcgtttattattcatcttttgaacgggtataagtgttcaattggcaaatatataagtttggggaccggcatgacaaaacgggcaaagtacaggtgccatttaggccattctgccttaaataaatagccacttatacaatggcattagctaggcatctcatttaccggcaactcctttcatttggcctctgtttttgtgataattgttagtttcattttattttggagtattcttactgtttatattattaatataagaatcagaagcctgcaatttactaaataaacaaaaggatcataaatttctgagccaaagctaaatcatcccgtgaaagaaaaacaacaatgaaagaaatagaaataacagtgcatataaaagtctctctctaaggtactatattttatatacaaagcaaaaataaatgttgaggagggaaaaagtgagtatattaattagcatttcactgtctgaagctgaattttttttaaaaatataactgaagaatggagatgaatgatatctcaatttagaaaaagatttgccaccgaattactcctcattaaaaaacgaaaaaaaaattgttatatggggcgatgcggggcgggtttatgcggagtgaaatggggcgggttgaaaatagaaaaattgctatgcggagcggggcgggttaaaatcttcgcgggttaaaattcaacccgcccgcaaatcgcctcgccccgccccattgccatatctaactgtatatgatagtaattctataaattgtgagcatagcaataatgtgaatcattaacttgggtcattacgagtggcggatcggagccaccttcatccaagaggtgtcagtcgatatttcttcgtcggaatattacactgtttagcttggcaaatttaaaaaatatatgtatacatactatataataacaccccttgacttcttgatgagtttgtttctttatattttgactccccttaataaaaattctgattccaccaataatcattaccaattgcatattttttgtgattatttcaaggattactgtaagcaatgaatcatcgaaaatgaacaaataaaaaaagattcaaagtttcaggcttccactacatgtcggaaaatgaagtagcaggaaaaagtaagaatacactatctgtagtctgacgcatgtagctgtgctttgtcttactgcagctgctagcagtctttgctgctctatctgtagcacgaaactatgatcagaattttttttattttttttgatcagaactaattaatgctaaagattaattacaaaaactatgatacgaaccgaggagtagtaattaatgcatgttgtactttcatctacgtaaaaatagtgtaaagtaggatgaatattaaggtcccgtttggtcatgagttttgccaaaataaatttgggatttatttggcaaactcatgtttggccaaaaattttgcccatattttagcaaaatcgcaaatctttttttttcaaaaacaacccaaaattatattcatgtccaaacacaactctaattttcaaatacaattttcactcaaaaattttttcacttttttttgttggaaatttaccgttattatgtccaaacgcccacttagtagggcagcacttgtagttgaataacaaagcaaattttacttatatacatttcatgattgaaagcatagcaaaatattaaaataatagtagtgactaactaattttacacaagggttttccaaaaagtggaggacaatgctaaagataacgggaaaaggctgaaaaacttaaaggtgaggtttagatatttccttgagattctacctaagaatgatagggtaaatatacttatttgaacttttgtgtttatagtgcaccgcctctctgccctttcggataggggtaaggtctgtatacgtattaccctccccagaccctattttgtagaactatactggatagttgttattgattatcaccttgatttaaatctacatgcaacagatgcacacttttattaatttggcataagtcataccgtaaattttgaattctgaaaaagagagtaagaattctaatatatggtcaaaattattgacagctttaagcagcgagtttaccgctgattggcctgaaaatttcttaaattggtgaaaaggaaattgaacaacattctgaacctctttctttttacctataatgagaagtgtagattaatggcctcagccaaaatgaacaacgaaatataaaagaaaaataaacagccaaagaaaagaaaattgatcagaaatgtcagaacaattaaactcgaatacatagacaaacacttaaactatcaacgaaagttcacttgaacacctcaactaagacattttccaccgaaacacttttactatacttttactgtaccagtttaacacgtccgacctttatgttgtactaagacaactaagacaatagggttattttatcaatatggttatttttatcaacaacataaaggtggatgtaatcattaacaacattttccctaaaggtcggacgtgttaaattggtcggacgtgttaaactggtgcaataaaagtatagtaaaagtgtttcgatgaaaaatgtcttagttgaggtgttcaagtgaactttcgttgatagtttaagtgtatgtctatgtattctgccatctttttaatttaggtttttcaagatcgtgaccgatgaaaactacataagaaatcggctcatttcatacgcatataatttggtacaagtaatttaagtctaagaaagaggctaaattatttcctgttaattagactaacaacttgtttggatggtggttacccattgcaggggcgaggttacaatacgggttcctgagaacccagtaacttttgcgtagatcctgtatttatattaagaaatttactaaatatttgtaaatatctaactgtgaacccaattattattgcatattaatctaaaattatggtaggaaccccataagcctcaaatcctggatccgcctctgacacattgtatcgaattgtattgttatatcaaaataatatttgttttgattgtttatttaaaattgattgtatcatattattaaatctattgtttctcgaaacaaccaaaaaccccattttatgaaacaaccgattgctgtggtgtgatcatttcctactctcttttttttcaattatgcccttacttattactccataattctattttatcattttatttttttattttaactttaaatctccaaccaattgacctgctttgtcttcttctgtgttttctagagttagtttatcccgttctgtttatccaagtctccgtttgattctttgtgtcattctattattgttttaattttttttgttgctaatattaattaactttcggcaacgtttagtatgtgggacaagggataattattccgagattagatacacgattattttatctcgcgtttaattaaatttttaaatctgtgattagctattccagaattaattaattccacaattgccaattggatattattctatcccactttgtgggttggataataatttgaggattaattgatcccgaaattaatacaaaacgacaaagatgcgcttctcttaggctcttacccaaagttttttaaacaattcaaggttaaaactataaataaaagtttatctcaatttatttggtatatactcatgtatccgtttttagtccaataaatcattcatcttccaataaaatatattcactaaataattccgtctttatttaatttttgcattaaattatcacattcgatattttatgtgataagaatgttccaccaaaacttaaaagtaagttctacagaactgtggttagaccgattatgttgtatgcgacagagtgttggctagtcaagcacttccatgtccgaaagatgaaggctgaaatgaggatgtcgagatggatgtgcgagcataccgggttagatagaattaaaaataaagttattcaggaaaaggtgggcgtggcccttgtggagaacaagatgtgggagacaagacttagatggttcgggcatgtgaacatgagaggcacagatgtaccggtgaagaggtgtgagaggttagccctagagggcctaagaagaggtataggcaggccgaagaagtattcagaagaggtgattaggcaagatgtggggctgatcaagcttactaaggacataaccattgatatgaaggtatggaggttgaaaattattagagagttaggacatgctgtggagcgttgtccttatctgtaatagcagctttagtatatgatttgatgttattttatgtattcttgtattccttgactcaagttatggagtacttgttattgctttcgtgtcggctttcagattgcagtacctagtgaatttaattttttatttttgcttcggttttctaattggtacgtttgttgttgccattccttttacctatgctaagccgtagtttcacttctttgtaaaagtgaaactacctcttttctcactcactgactatctttttacgaagtcagccaaaccaaaacttggaaatgcttttgtttatttagtaacaaattaaagtaaattttactaagcataacaaaatattaaaataatagtgactaactaattttttttagaacatgttatcagaattcaaactttagaaaattatggaagaatagacgtcaaaacaatccatatgagtgtcatatatattactccctccgttttattttatgtgaacctatttgaatgggtatagagtttaaaaaaagaaagaagacttttgaacttgtgatgtaaaatgaggcacatatattttgtgtggctataaatcattgcataaaggtaaattgttcccaaataaggaaaggggtcattctttttggcacagaccaaaaagaaaataggttcacataaattgaaacagagggagtatatgattctcgaatttcaaatgagtttacagtcatttccctatatatagacatcattcccccctctctctctcctcctactatccttctttcccttctctctgtcactatcacttccaaagaaaaatggtgaagaaaagaattatgctttcactctttgttttgttttacctcatgagtatttgcatgttgtttcttgatggagctttggctgaacaaaaataccccaattggagctacgctggtgttgtgctgatgatttctatttgctgtgcagttccattatttcctcctaagattaaggtccaaatagtggccataatttctcccgtaactgccaagttgttgaatcctattgggcctctggtggctatgattgtggctattatgctgagcttcagagggcctagtacatgttgtatagatttttccatacaagtgcttttttttacactatgtaccttattccggtgtttttaccctttgtgtgggatggcggtgagcatgtcagttagggattacggctgctcaggagacacatgggtcactattattgtttgtgtataacgatccgactggtcgttttgagctttagcgcgtcgttgggcagttggaagtttttgcagctgatgcctattagtgaggtttttttatggttctagtagtttcattaatgggttttggcctttcatggtttgtatgaatggtatttccaactatctaaatgatagagctagctatgtttctgaaaatactcttatgatatttgcttattagctttcttactatttgaatgataaatacaacttgtttactgatatttgtgtggtatgtgcttattttaatgggttacaacagtagttttgtgtggttggatttattttttcaaaagatttttgaaagcaatgtttgattatgaaatatgatcatgtattggatttttattttttaaagtttgcaagttccttaaaattggtttatggtagtttttgggcgtaattttttcttccactcataaaactttaatttttcttcaaataaaatgtatgtccaaacacaacttcatttgtcataattatttttcaacacaactttaaaaactattttttcaagtttcaatcatatctatgtccaaacgctagctaaatcaattatttcctttaacttttaattttttgccttcaaatttcaattaaattatgtccaaacagtaacaataatacccaatttaaactccaaatactgatttttttaattctaattttaaatatcaactatatctacttttgggcatagaagaaaaagaaaagacaaaggactatgccatcactcttttatttattttttaactagtaaatttatcgcgctttgcgtgatgtgaaacatatcaattgcttgggaaatagtctttataaatttactcaaacataaaattttcaagtatgaaaaagaacattaataaaatttatttaatcaccgcttatctaaataatccttgctaaattacttctcgagtttgttaacgttggtaactaaataattttctttaatcaccaagtgaacaaatataaaatatagcaagttctcagctagcttatatccagtataactccaaatccaaatccaaaccctatacaaaatctgatatctaagctcctgaattaaaacttagaacaaaaaaagggccttctacaatagccatttcagatcccctacaaccttgaaattgcatatacacgctctatgacatgaggctacgcatgtacaagcctaacattataacagaaatttgaataaccctaaaattcattgaaaactgaattgcattattctctggaaagtgcagctatttagtcatattacaaaaaattcccgaaagctcaatacaggaagctaaaaccaataatacttcaatagattagaactttcattttcaaaaggaacacctttagtcttcccactatgtattttagatttataatgcattatatgactcaacataattgcccctccacctttttacaaactgtaccaaatttttacaaacttaccgcacaatcttaatggatttatttatatagtcttttagatgactattctcataaaaaaaattcaaatcttattctaagaccacttttattttccttcactttcattctccatataccatttgtagttaattacagttgaccaacaaagagtaaattgcagtacaccaacaaaaagtacaaaacaggggaaaatacgttgaagaaacatcaagcgtaaataatttatatgtgtaattgcataaaagaagcaaaatttaaatgaaagattaagaaaacacacaaaaaaaaaatgactaatgttaattaagtggtaagaaatcacaaacaatgagcaattaatctaagatagctactgctttggaaaccttaacaaattcataagtttgtattagtgtctcagttccaaccgttgcacataaagttgttttgcctgttaaaaagaaacatagagagtaaaaagtgttgaatagcagatttgatgctgaaattgtggatcataaatttcaggaggaatacactattttgtctaagaagggaaaaggttaccagcattttcttcctaaatggttgatcggtttttagtggtcaaaagaaaaaagatcattggaaaaatgaagaattgaatacatgaaaaggaactttttttaccatggaagagagaggatggatatgagcgttcgagaagaaacggtttggtaaagctacgactatcaatcaaaggaaacagaacgtttgcgtttctccaataagttaacccttcggattagttaattaatgggaaaaaataggataaagccttcaatttttgaggaaaaagatagaaagaattctgatcattaaagcatgccacgtcaccgggcttatgccccttaattatatatatatatagatagatagattattcaaaggatcaattaaattctccgtctcctgaaatcctttaaatgcaaattttgttaattcgaaaggtggtagctatacaaattatagtcattattaatagtagcttctaaatacattatgttacagatgaattatattcctattagatacagtctactcctattagagtcaaatatctttataacaatttcgtttgttctgaatatttttgactgttataacgaattattgttaaataaagaacatattataacataatatgaaagttaatttctaaaaagattgacttatatagtaaagtgttattatatagtgatatttttattgtgaggtacgtaaaataaagcaaaagcctttaaaagtgaaaatgataaattaagaaggtggcgatagacttataataatagaacctgttcgtaaactagataataaaatggagaaatgtgtcaatagtttcacaatcttggcatataagaaatttgggtaatgatgacaaattattaccaacattacatacattcttccttttaatttagatgagatagtttattttgatacaaaaggaatttttttttataaaaaacttgtgatcttaaaagcttaataaataaaaaaattatggggccatgacactagttataaaagcttctcataggtaagaagagtaaaatgaagattttaaaattgaattatttcaaaatatggaaatatgtcatttattccgaaagaaactaaaaagaaaagcaatttatttaattgaaacggagggagtagtacctttaatagttataatacccgatttgacggctaagtgactctagacctccccaaccccgcacccggactttggaacccaattgtggttcttttggactcaaaatatcgaaatatatggaaaaaaacttggtgatcaaagtatataaaacgtgcttttaaaccgcgttttaccctaacgtcccaaaatattttgactaagtatatacttacctagatatacaagatttgaaatacaaaatctagaaaactaaagactcaaatctttctattgtattcttggatccacaattaatcctatggatccttaggattggtttattcttttctatcctttagtttgtagttttcccgaatcaagccaagtatcacacctctttctacttgtcccttttgttccgtgttgaaatagaaccttaatttattacttatattttttattagattttagattgttactgattagatattagtattagacgatattttatgaaataattattttttgatttctttataggagaggataaatatctttttttctatgcgaatttgacgctttatataaaatgctttttaaaaaattattttaccttttctgattgaacgtttatttaaaaagccttaataaaccacgctttgcctcttcataaacaagaggggttgctatgatggtgagcaaccttcatttccaatcgagaggttgtgagttcgagtctccccgagagcaaggtgggaagttcttggagggaaggatgccaaaggtctatttggaaacagcctctctacccaggataggggtaagatctgcgtatacactaccctccccagatcctactaagtagaattatactgggttattgttgttgtataaaaaaaaaagtgaagtcaaagtgtaatcaagacctttaccccatttgagagaaacaagggtacaagtcgcgaagatcctgtttgtctatattatacagtatacaggactgaaaaaacacaaaaaaaccatatgcggttcttatttacttgtctacataataggagtattaggtggtgtttggacatatattccctaatttattttgaaaattttgatttggtttgaagattaaaatgtgtttggacatccgttttcaaaatatatttctcaaatttattttggaaaaacatgaaacatgacttatacccacaacttcttaaaactatcacagatacccaataataccattatcaataacattcattatattatcgcaaaccataatcctgaacataaataaatttggtacaaaactatcatttttataatgaactacatgatacactatcagatgaatgacaaaacgaagcaacattgttccaaaataataaatggtgggctcttttataaaatacaaaaaattgaggcaatttttaaaaaaaaataatagtgatattttggcccaaaatcagctattgagctggttttgggctttgaaatgttgtcaaaatataagcaaaatctatggtcaaacactcattcaccaaataatagccaaatttattttgacaaaatctattgccaaaagggtctttagttttgctcgtttttaccggttattattagggttttccattggggcatttgtagtcgtacccgttttttgtgtcacattttaacttatgcccgctttgtctttctgtttgcaagcgtacccactttttcacataacttcagcccacggggctgaagtgtttcttttgtaatggaaaacttcagctgaagttttacttaagctctagagcttaagtttacttaaaccgtctccagcttaagttttctagtacaaaagaaacacttcagtcgtttccagcttaagttgtccagttataaaataaatacttcagctgttttcagcttaagtttctagtacaaaagaaacacttcagccgtttccagcttaagttgtccagttataaaataaacacttcagccgtttccagcttaagtttttcagtacaaaagaaacacttaagccgtttccagcttaagttgtccagttataaaataaacacttaagtcgtttccagcttacgttgtccagttataaaataaaaacttcagccgtttccagcttaagttttccagtacaaaagaaatacttcagccccgtgggctgaagttatgtgaaaaagtgggtacggatacaaacagaaaaacaaagcgactacaggttaaaaaaaggcgtccaaatagggcgccccgtgcgatttttacttttccatttgacactaaaagacaaggcttggaccatgtttaaaattgaactggtcaaactccaaacattaactaaatatttaatttatataagccaaaaaagttggtccttatatttttatatgttattagcttatatggaaatctacttcttaccaataaaacaaccagcttggcaagttctacatttttgatatattcacataataggtgattgttcaatatctccattttcctcttccacgtgtccttgatcctccaatgtaatagggatacataaaaattacaagtatttaagggtcatcgaaaaatttatgaatcgggatgaagaacgaagtagaggaagaacgtagagaatcagttgagcaaattcagaagaagatgatatgatgaactgtagaatatttttcttatcctaatcttattaatacaacaatttcaaacacactttcccaattgcctgtggttggtgcacaatttgctttaatttagtttagttcataccgcaagaatattgatatcatgtattagaataacgtctttttgataacgagagtcaggatagtgtatttttttcatttttgacattttatttgttgtctattagactcacgttgaatgagtcatttcttgccttgcttaatagaaaactaggaaatgtgagtgcacattatagtgcttatcagcgtgcattaagggaggagaatttgttgttcattttggtactatcagttaatcctctttgctttttccatgcttcctgtattatattactttcaggtaattacttgactagtagctcacggacatcattgatggatgatagaaggcatcctctgctaaggctcttgcttttcttgaggaaacagcagaagcatcagaatatcctaaagacacattgcttagggatagttttgcagcttcaagagaatattttacctgtttccctatttcatccatgatgatcatcctgggaagggattgaaccaatcgagagagagatccaagggtggtgccacaatgaagaagattgaagcatgtgtgatgcctagataacacatccaactcccattctgcaaagccttttgcactggttaaaagtacagatgtggcaaatgcaccaacataatggttctcagactttagaccaaatagctggcgcagttgtcccatgaaaacttcagatatcttcttcaagtcctcagaggaaattttgtgcttgggaagatgttgaatttgtaaattgtctgaacaggccggtggattccacacaataatacctcccaacattggagatataaagccatttgtcatggatatctctccatttggaaactgcaactttagagggcactcttttgcagatggcacatatagcacaaaatgcaggacttttgaccgccctccggctgctgttgaagtatccaagtgccattatttgaatttacaaagaaaggaagatcctttgtactgaaaatatagctaccctggttgtcatcccaatacgaatatgaagcctttggagtatgatatagaacatggctttccacactaatatcagccactggtcttaaagcatcgacaacgggagccagcagaatctcatctaactcctgaaaatcccagtcataaacccaatcatgcggatcagaattcaagactgaatgaaagcacgaccttgccatctgcacctactggcaagaattccccacgaattgatccttcttccttcccaccattcacaaacactttgacaaaaatctctgacatcttctcacagatttctccacagaatcttttcctacaatccaagcatgcctatattttccaacaacaactctcacctcctcttcatccgcattcctcttcaccaccacaaccgtataaagtttactattcttgctatccaacacagactccaaatactcatcaaaatcctcgtcatcatcgttcagcttatcaaatttattcaatgctccgcattgctatttacctacattttcgctttcactatgaatacagttggaactggaatcaactgttactgtcacagtataattatttccgcacgttgcacaagctggagtaactttcgaagtcaacttttgcatattagaattgatcaaaagccctagctcatttatatcagtgatatcatcgaagtttataaaaactgctcgaaattggcaaggatgaagatttcaatttaggtagatattaatactgacatcttacctgcagttcccaaagcagaattccatcagtcatgaattttatggagcaattgtcttttatcctcctgtcatgtgtaacttggaaaacaacctttttgccaagactaaaacaagctcaaatgccactcgcttggcagttgcaagtactgcaacacagcgtggttgagtcacaccaataataccaccacgaacattggaatgatttgagccatagagagcttcataaaggaactgaaagatcccaaatcaaaagcaagagataaaaacagtaaaacaaaactaaaaattaatgaagaacaaaataaatagaactctatattaccaaccgaaggaaaaggaagcatatacagaacaatagaatttctcacctgaggaacttaggctgtcttaccacaacctgtcttagcacaaactattacaaatttgttctcatttatagcttccattatctgctgctccatcatgactattggcagatcgcacctgttattttgaacctcctttggtcttcaaacatgcaacacagttggagttgttaaagctctttgaggaagacagttagccgagttgttactattgctcagactcgcattatgaatatctttgctaccatcctgttcaatatgaagtgcccacacaaaatacgttgatgtggatggtaagttaaccaaagtgtgtgagaaaatggacaaaaaattatatagataccatgctgtccaacatgattgttgcctctcataatagtaattgctctgctgataaaaactttattggtcaaatggtttatgtgggtaatgcactgttctatcattcaacggacagataactcgaacctcacaattttgccaatcacaactaaataataagaagatatttaatgcgaggcagaaagttacgtctaaatagaactcagaaagacagtggacgaacataaatgacatgcctgcattgcaagtttgtttccggcttgttatccaatattaatgatattgaaggcaggaagtttcaacaacaacttcttgtgaccaagcagatttccaaagtgctgaggaagagatcatgatggatatatttgttacatcatgttcaactccaagatggattatttgaattactcacatatatactactgtgtgtatatatacacttgcgctgctaattcatatatactactgtgtgtatatatacacttgcgctgctaattcatataactattactgcgcagatgtaatagaggtcaagtatagcagcgcaagtgtatatatacacacagtagtatatatgtgagtaattcaaataatccatcttggagttgaacatgatgtaacaaatatatccatcatgatgtatatatatgaattctctaagagcaataaacgacatcacattttgtagtggcttgattatttatgtgttacaactattgtttgcttcatagctttgcaatcctctttaaccaatatgtgttggctatctagtttattaatagaagtgcctgttggaaactattcctaaatgtttttccttttccccattgttgtacagctaatatagcgataattaagctagaacaaatgtgtgtgaaccaaagactgatcacaaaaagaaagagagaaaataactcataacttatatactaaagataattcaaatcaacaaggcagctgctccaactcctttttaccatgagcaggaacttcaggggcacaatatgtcaggtatctatacaaacatataccaaagcagaagctcaaaactatagctctaactaataattctaccttcaacatgtaagcaagaccttgcattactaaccccaacattaaatctattcccttaatatcatatgctacgcgcaagaagtgcacataggcacagaaatatccggtgcagcctagcagtagagcaggatacccataattgaaatccaaaaggtgacgcaaggctgctgcagttaccagaggaatgacctccatcataaatttagccttggcaccaattaactggaaaggcatgtcgcgatgccaataaacaacagagtacagcacattgatatgtagtataaagcaacaacccgggcaaatccagacgacaaaaatatacggatgatgaataccccctaacagcaggaaggcagcggccaagcactcgaaggcaatgttagcaaaaatataccacaaatagtcataaccttctacaagaggctctgaaagaaacacgagaagaaaacattcagtatctcaaacaaagttatgaaaacacaaaatcgaccacaccaaaacaatgaacactactattagaatggtcaacgtttcacaaaagatcgccactttaaagtctaaaaggaagcatcttttagtctccaaacaatatcagcaaagtaaattgtggaattgatctgccacccaaactaaataaataccgtataaagctagtcatttcttagcatggttaaccaagaagtataatgaatataaattgtcacgaccctagttcaccaaccgtgaacctgtcatgacggcacctagtcttcacgactaggtaagcctaactcattgcggaattaacaacatcatcataaaaacaaataccaacgctaaaataccatgaagaaaatgtataaaggtgccacttggcacgtacatttataacacaaaactgaagcaactcccaaaacccggaatctcacaaatcacaagctagggaaaagtacatagggctctgactcaagaatgtctatacaatggaaatactggagaaacaattacactattacagaagctgaaaagggactcctcggtctgcggacgcagcagacatacctcgaaatctctaccgatacgcctccttctaaggcggacagaaacgactgggagtacctgtatctgcacaacaaaaatgtgcagaagagtagcatgagcacaccacagcggtgcccagtaagtatcaagactaacctcggtggggtagtgacgaggaacagtcaagacacctaccggtcaataacagaataatcatgtgaataaggaagacgatatgtatagctatgtaaagactgcatgaataaccacaagtgctacagatccataacaggaaaaaggcaacaagtaacttcgataacataataaataatggtacgaatgaaggcaaagccacaagccaaatcctaaagccgcagcacaacaaggacaacaagtcactaactcatattctacaacgatgctcacctacggtcttactcaactccttccacaattattaccaacatctcatttccgtcacaactcacgaaaacctatcatctggagtctaacacttggcgtcctgtgccccatgaatctcacggtcatgccgaccactcattggctaactaggccactctcacatgcatatataaagtataaatgagggtgtacctccacccttagccaaattggaaaggcttcacctctaacagggtgtccggctaagtgtatgcttgtgcaagtgattcgcaaggattctaccaactagtaggtataagaaatgacacggccatcgcccgaaatagttgcacaattacagcaattcaggacagaatatacatgtcagcaacaactgaacgaaatacagaaaatagcacgaaaaagtgcagctcaataccaatgatgccataaggatctcgtaggataccgtcctgtagtcctttctcaactgtccagtggatctcccgggataccgtcccgtagtccaacatagcaatcatatccgaaggatctcccgggatcccgtcccgtagtctaacatatcaatcatatccgaaggatctcccgggataccgtcccgtagtccaacatatcaatactcagtactgggggaatctaccaggtgcaatcctgtagttccatacaactgtgcagggggagctaccggaatcccgcatccgtagtcccaaaataaatacagggaaaactcccggaataccacatccgtagtcccaaaataaacagacaagggggaactcccgaaataccacatccgtagtcccaatataaatgcacaccaacagcaagagaacaacaacatcccagcaagggagtcaacaacagatacaacaggtccagacaagggattcaacaataagaacaacaacgtcccggcaagggagcaacaatgaagtaataacgtcccggcaagggaaaacaacaatacaaaaggaggatcacggaaaacccaataggcacaataacctcaataagaatatcaaaacatgaagtgcatgctagctacaccggtaaccacaacagttggacgtatcacctatttgcacgtagtcacggatgaatttacgatcaaggagtatccaacaataaggaagtgaacatgaatcaagtagtgatgactaagtgattatctactagacataggatatctaacttcttttcatttacggcctatatatttcatgagaagtaaggacaatgatcttccaattagaggcaagcagtttggggggataacatagctataataggaataacgtcctcagttaaacaagtggaagtcaactaagcagcagaaataacccaagggcaaataaatttccaagtaagacatgttgaaatgagactaataacgggaaaacttaatcatgtcaagaacaacttcatccttagtgaattcaagggtctaagagcctaaaagaatcaatttaccacaaataaatccgagcacacactcgtcacctcgcgtgcaaggaatacaatcaacatagaggactcaaatcctaagaggaggtcccccacacaaggttaggcaagatacttacctcaaaaccggctaaaatcaacaagcaaccacgttcttgccacgagttctcgactccaaatggcccaaatctattcaattaaatcacatattgtaaataacatctcaagcaactgattctacaattcaattcaaggctaaagcgcgaaattaggtaaaatgaccaaaacgcccctcaggccaacatctcggaatcagaatatttttacattttcagaaaccttacgctctcacgagtctaaccatataaagtttatcaaaatcggaggtcaaatgccccctcaaaactcaataattcggtctatgaagttttacccatttttcattcaaaatttgaaattaaaggatgaaattaagaggagattcatggaatttggtctaaatcaagtgaggaacacttacccaagttgcccaggtgaaaattccttcaaaaatcgccaagaaccgagctctagaagtcaaaatgtgataaagtggtgaaaccctcgaattgggaattaaaactgttctgcccaggtagtttgtgcatcgcgatcgcgggaggaaggtcgcgatcgcgtagaggaaattcccaggctgcccaggttgctcatcgcgaacgcgatgggaaggatgcggacgcggagaagggtcgagcagtgcttcgcgatcgcagaaacactagtgcgatcgcgttgaaggaaataagggggtccagtatttggtctatgcgaacgcggaactcttcatgcgaacgcgatgaagggccaatgtggcctacgcgatcgcggagactagatcgcgatcgcagtgaaggaaaccagaaacaacaatcagcagttcaaaaacaaggagaaatgacctgtagcccatccgaaacacacccgaggcccccgggaccccgtctaaacacacacgcaagtcatataacctaacacggactcgctcgaagtttcaaatcacataaaacaacatcgaaacgacgaatcaaaccaaaaatcaagctaatgaactttcaaaacttcgaatatcaaaactcgtgccgaaacctatcaattcaactcggaatgacgccaaattttgcaggcaagtccaaaatgacataacggagctgttctaactctcggaatcgcattccgaccccgatttcccaaaagtcaactgtgggtcaaacttcttcatttccaaacttcaactttcgccgaaatgcctcaatttactccacggacctccaaatctgaatccggacacgcgcctaagtccgaaatcaccatacgaagctgttgagatcatccacaacccattccggggtcgtttgcacaaaagtccaatttcggtcaacttttcaccgttctaacttccaaaacaaggtttcttctctaaatttgactccaaaccatccgaaagcagaattccaccatgcacgcaagtcgatactcctgttccgaagctgttttagaccttatgccgttgaacggagcttaatttcttaaaacgaccggttgggtcgttacataaatcctatggccaagcgggaaatggcagaaccatgcaccaacttcatacactattattatctctgctcaaaggaaatatcataaatttgtggcaatgtcaatgaaaagactataacatagtgactacattgtcaaacttaatcattccttaagttcaatcacccttttattttttttattttttttatttgcaccgggtgtccgagtctcttcgagccccgattaatcccgggggtgcacaggccctcggcaaggaatttctcgcaagtgcaccacggttaattcaggttttaccctgtccgatggccctcagaaattgtttgcaccccgtgggtttcgaacttgagaccttgaaagggagcaaaccccaaagctcaagtcaattgccaccaggccaacccctgagggttccttaagttcaatcacccttttatgtgatagattgctagccttaaacaacctcataattccaagtccagaaactcaatctttaggttaaaaaaagacttactgccaccggttgaacgacctaatagccctggcgccaaccaattaaactccataaaagatgaaatcacgtccttcaacttctgatagcaaatcatgcgcgtgcggaggaacaggccacgggttgcaggagaggcagagagagggagaacttgagaggaatcacccatctggctgcagatagatacaagtctaatacaagattttatttactgatttatctattttgtgccatcaaacaacaaagatatgtaaaagtcagtagaaaggaataacaggagaagatatgttgaaaaaactgttaacaagaaattttgcccaaaaaatgaataaatgcggaaacaaaagtggtgtgtgtgtatacacacgtaactcgaatgatcatatagatgataagaaattcacaagtcagtcgaggatttatgatctgaaattaatttcgaaggcactaaacaacttgatgccctaagtccaacattgataagaaatatctccctatttcagacaacaacctagtaaacaatggcggagcccttattttcattaaggggagtccaaatataaagaaataaactcaccaagaagtcaaagggtgtcaatatatagtatatatatattttttttaaaataacccagctacacagtataatttttcgacgaaggggtgtctttgaagaaactatagaataaaaagtggggccccctaaagttgggggcctaaagcttgggcttaagttgcttaatccaaaagtcaggcatgagccgtacgtagaccttacacctatccgggaggagtagagaggttgtttccgaaacaccgtggagtcaaaatcccacgggtggtatcttggtttattgtttcagagacgcactgaaatctctatttctcctttttaaaattttacaactttacataactaaaccaaatctttatcttaaatctagtagtagcagaggatgtaacatatagtcaatgattcaatcaatcactccaacagtttcttaagtagatatatatgtgaaaggccacttgaacctataattatacaagtgatgaatttaatggtaagaacctaagagttaatcggtcaaatttaaatcattgatccgcctagtgcattaatcctcgtgaaatccttgatccgtttctgcttaaacaaattgcaaaaaaccagaaaccaaaatacaagtattacattgaattaatgacctggaagagactatccaaatccggcggcctgcaacaatattagatgacaaaagggtctacggttaaaacaggggaaacgaaagaagaaacgggagagctgttgagtttttccttttttttcccggcaaagggtgtactagaatattaaacgtaggattcagatttaaagataagggacacgtgtcacagtgtatagagctagagctgctttggattgaaccatggacggttcagatcaagtagttcaataagtatcctgcggtccagatcaatttcctaagaggcttttgaaacattgaccggaaaataggctaatttttagctgccctctttagaagaaactagtatacgtaccctacacctaataaacctagggtgtgttttctaattttcccatatttagttggaaaatatttcttatgaactaattttatttttttttatcgagagaagggaaaacattttccaaaactccttctcaatcttccttacccttaccaacccactccaccccctctccaaaaaagatttttttttttaaatttcagttttttcgttaccacccacactactatccatctaccccacgacacccatgccccctctcccgcaaaaacaaaagttttttttttttgcaatttcaaatttttatttttttgtttttctacacacccacccccacctactccctccgccctgccccctgcccccaccccgaaaaaaaatattttttaaatttatttttcagttttagtttttctatttatcggtttaaaggttcaaaattttacaagttccaaagttatgagttcgaaagtttatgtgttcgaaattttgcggtttcgaaagtttagcggttcgaaagtttttgaaatttgtgggttcggaaggttgttgatttgaaagtttatggcttcatgtttattatatctaaattttttttgaatattcttgagaagtcattttccttaatttgcgtaccaaacactagaaaatgaataagattactatttgtttttaaagaaaatattttcttgaaaaatattttacacggaaaatatttttcgttataccaaacacaaccctaatcgcctcatattttccttaacctaattaatcagcttggggggagaatagtgatggagatgtattgcggccttctcttgttcatcaactcgaacctcattcttatgcagttgatgttacggattagcctcactctttaggccagcagctttgcttggaaaacgggcgggttcagttgaatttgggcgggtcaagataggttgagtcaataaatgggtcatgacctaacccagcccaaagtgtacttggtttaagatgggttaaacaatgagtcataacccaactcgcgcaacttgacggcccattatttagaaccatgctcatcttgcataaataaagtcttttatcttttatatacctatatatgttacctatgttcttagcttcttcataatttattcattccatacactgactcggactcccaggtcgatgcctcaacaggctgacctcgccactgaacacgaacagaagcgaaactcttcgatctcaactaacgaacccgtcggtctggaatagctaccggctcttcctcataagacagatctttgtccaactggacagtgctgaaatctaacatgtgggatggatctctgtcatgctttcgaagcatggacacttgaaacactggatacacgactgataaactcggcagtaatgcaagtttgtaggccagatctcccactcgatcaagaatctcaaatgggccaatgaacctagggctaagctttttccctcttcccaactctcatcacgcccttcataggcgacacccgaagcaatactcgctcaccgactatgaatgtcaaatcacgaaccttacggtcggcataactcttttgcctggactgagctgtacgaagcctatcctgaatgatcgtgaccttgtccaaggcatcatgcactagatctgtactcaacaaccaagccttttccggcccaaaccatccaaccggcgatcgacatcgcttaccatacaggcctcataaggatccatttggatacccgactagtagctattcttgtaggcaaaatccactaaaggtaaaaactgatcccacgagcctccaaagtcaataacacaagcctggagcatatcctccaaaatctgaatagtgcgctcggactgcctgtccatctgagggtgaaacgttgtgctcaacccaacccgtgtgcccaattaactctgaactgttctccagaaatgtgaggtaaactacgtacctcggcccgaaatgatagacacgggcacaccatgaagacgaacaatttttcggatataaatctcaactaacctctcagaagaataggagactgccacatgaatgaaatatgctgacttgatcagcctatcaacaataaccaacactgcatcaaacttcctctgagtccgtgggagtccaacaacgaagtccatagtgatacactctcacttccactcaggaatttcaatcttctcgaacagacaaccacgtctctgatgctcgtacttaacctgctgatagttcaaacaccaagccacttatgtaacaatgtctttcttcattctcctccaccaataatgttgccgtaaatcctgatacatcttggcggagcccggatgaatagagtaccggaaactatgggcctcctcttgtgacgacccaaagagtcatcacctatttttaatgaaattttgtgtctccaaggccttgaaaacctcatttggggtcgcctcgatttgtgtgtgcagtccgggtgcgtagccgaaaagcttaaacatgaaattctatgaaaaatgctaagttttgagtttaaaatgaataaatttgacttaatgtaatagagtctttatgacaactaatggcattaatgtaacgttataattggtaatcataactgattcactacaaatttcataacgctttccataattaatgcctattaattacaaataatacgtatatgtacctcttttactataaaagttcattcttctgatataactgctgaatatcaataggtatgagcttttgcccttcctgcccgtgcctgttgaaactcgtgcctttttactttgccaaaggtcgtgatttcatcttttatggagtttaaatggttggcgccagggctatttggtcgttcagacggtggtagtaagtcttttttacctaatgattgagtttctcgacttggaattgtgagattgtttaaggctagaaatctatcacatgaaagggagcttgaacttaaggaatggttaagtttgacaatgtagtcactatgttatagtcttgtcaatgacattgccacaaatttatgatatttcctttgagcagaggtatcaagttggtgcatggttctgccatttcccgccgctactaaaaatccggaaaaagcgaccacaaaaagcgaccaaaattggtcgtttacaagtcataaaacgaccaaaaagcgtccaaactggcttagtcgctattttgttggtccattcaccttagagaccaaagttggtcactaattagcgaccaactttggtctctaaggtaaaatgaccaaatattccggcaaataatataccgaccaactttggtcgctttaatattttaataatataaatttagcgaccaaagttgctctctatatttaaattatatttttttatttattattattcaaaatatagcgaccaactttggtctgtaacccaaatattatattttaaaatccgaaaaatagcgaccaaagttggccgttttttttttaatttttaaaattttttttaaacataagcgaccaaagttggtagctaatttcaagaatttaattttttttaaacaatagcgaccaaaattggtcgctaatttccagatttttttaaacaatagcaaccaaagttggtcgatttttagaaaatctgggttaattagcgaccaaccttggttgctattgccgagaaaatatattttttaaatagaaaagcgatcaaagttggtcgcttttttgggtataattttggcagctataccacctgccaacataccaaattccctattacaagcaacaacaacaacaataccaacaacaagaccaccaccaacaacaacaataacaacattaacaataatattaaaaccaacaacgtataaagttcaataaaactaacacattaagctaacaaaactaagttaacgcttattacaagctcattcgaaaatcgattctattgtctagttcaaagtatataaagtactcaaggagtgttctttcagcatctcgtctgaaagttggattgcctcgcccgactcattaggtggatgactgcgtatgaattcctccacgtcagctgtgaagcgaccctataagaaaaattatattgaattagtatttcaaaatttatataaaagtaaatcaaaatacttaatgaaaagtaaaaaaacttacatgtacagtcgaggctcggccctcgacccacctttctagatcagtctctttcttcttctttacaatacgagtctcattgaatagctcatcttacttcattggcatcataaagttgtctagtggctttggtgattatcctcgtagtaatattactcgggataaacttggatacagtacctggcagggtgtgtctttgatcaattgttgttcttattagcgacaatgatgatgagaaggcaatgacatgtgtttcaaacaatgatggtgtaggtaggaatttaacatttcctaggcaaataaaagaagaggttatagagaaattctctatttcattttccaagaggaaaagaagtttaattgagagtgacaaggttgatggtaatggaaagttgtccgttgctcatggcagttcccataaaacggggatcataagactctgtgatgacaaagacgaaaggaagttttattctcaactttcttctaagtttgatctgtacaagcttaatgggattggtgatatttcttcggattcagacaatgatttgagtgacaaaagtatggaaatgctaatcaaaataattaaaggtaaaacgtttttcttggaagagaaggatgctgaactctgcttcccctttaaaggttcaactcatatcccaaagttggtctctatctgcttcctctttcgtaagcgaccaactttggtcgttaattttaaattatatttatttatatttcataatttttttaaataataatataattattaaaattttataactaggtcccactttagcgaccaaagttggtcgctaatttcaatatttctttgaccaagcaagtctaaccagtccggtcaactttttgaccacattatcgaccaaaaagagaccaaccttgatcgctaatgtatttagaataattatttgataattttctccaatttagcgaccaactttggtcgcttttcttgacagaccaattttggtcgcaaattgttggtcgcttttttccgaatttctagtagtgcgcttggccatagaatttatattcattatatatacttctttatactgtgctttttaagtttgggtggcagatcaattcgataatttactttgctgattgtttggagaccagaagatgcttcctttaaactttaaagtggtgatcttttgtgaaaagttgcccgttctgatagtgttgttccttttttttttgtgctcgattttgtgttttcgtaactttctttgagatgctgaatattttcttctcgtacgcgtttctttcatagcctctcgtataaaggtgcacttagtaataattgaaccataaaactctttgaacttgtgtgcacacatatatatgaagcaatttttaaaaaaatataatattattattatacataatataactagaggagcattggttcgcatgccccatgctccaatacatagatacgctcctaccatggactatgcagtctagctatttttgtccttataagttaacagaatgaataagttgttcatgttttgagaatttgctgttaagtcaatactactatagaaggtagaagattatacaaaaaagggccaaatatattcctatactatcagaaaagagttaaatatatttctcgttatactttgaatttaaatatattcctattcttataccattggtttaaatatacccattttctgttaagtttgtccaaagtggacatccaacttacgtgacactgacatttgatgagttggatgtcacatggcttgacacctcagcacccctaactcattttacccctcctttctatttttttcctaacattaaaattttctttccctccatcactattatcgttattatcaccactataaaaaatattttagttcaaattttagtcttttatatatggattaggggcgttgaggtggcattcccatgcgtcgttcacctcatcgagtatcagtgtcgcgtaaaattagatgtctatcttagacaaacttaacaaaagcggggtatatttaaatcaatagtattacggcagcgatatattattgtgtcctactagtttttgttatgatcagattttaaaccaaaaattttctggtgttgcggctaattccttagccgaggaaaaagggaaaaacaaaaaaaaactcaacactacagccttgccgtttcttcttcgtttcccctgttttaacccttgacccttttgaatttggatcgtctcatccaggtaattaattcaatatagtagtagtttatattcaatatttttgttatttgatggcaatatatataaataagtaaataaaagggagcttgaacttaaggaatgattgaatttgacaatgtagttactaggttatagagagcgtttggattggctttcaggctggtcaaatcaatctttttatcttctttccgtgtttgacaaagttaaaaattatttaaaataagttaaaaacggcttaaaacaagacaaaagcaatcagctgaacaactccaacttattgtttttgagcttaaaagttatgtatgctgaaaaaccacttttttaagccaatcctaaccggagtcttgtcattgacattgccacaaatttatgatatttcctttgagcaaaggtaataacaatgtatcaatggttctgccatttcccgcttggccataggatttatattcattgttttggtgtgctcgattttgtgttttcgtaactttctttgagattagtaatgcaggttcttgcttacatgttgaacataggattattagttagagctttagttttgagcttctgctttggtatatgtttctatagatacgtgatgtattgtgctcctaaacttcctgctcatgataaaaaggagttggagcagctgccttgctgattggggtgaagctactctctcgtaaaggtggtcaattgatcactctttgttcgaaaattacactgtatatatagctaagaattaggttttagaaatatataacatatattgaacatcctttatcgaagaattctgttttgctttttaaagcttgaacactcttggagaaatttctggcttcgtacaccttgctgatttgagttatctttaataagttattgagttattttctctctttctttttgtgatgactctttgctttttcaagatcagtggccagaatttttattaatagaaagactgacagtatccatctctactaaaatagaaagctctgggtaatctcttggataacacatagatcagtggcaccttctacacttcttcaatattttcttcaattcaagatttagagtctaattcaagatttcttaggtcaatttgggattgtttggttcacattttttggaccttttttccgtttggtcaattgctcccgttttgccataaatttttgtttggtcaatttgggagtttttttttctttcaaatatctgtttgtttatagattttaattatttttggcagattttgaatataaaatcttcaaatcctaaaaatagctcaagaataattttgaagtttttgaagatttttagtcacaaaagttcaaattcttttcaagtaaaatgcatgtccaaactcaatttcaattttcaaaaattattttcatctcatcttcaaaaatttatttttcaatatcaaacctatattcaaacactagctttatttcgagtctaattcaagactcttagatcaatcggggatcgtttcggaattttccgttgatgtttggttttagattaaaagtgagatatacgaatataatatagaataaatctttggttttaccgttgatattgtattggtctaaatttggcgacttggtagtattggataaacgagacccacgacgcagtcaacctcagtgtaatagcaagatgtcgctctcaagagggttgatgccaaagacggcaaccgaggtgaagaaataagggcaggataagttcagctatagacataaggagtattcatttggatattccttatgttgtactttttagggtttttagggaatatcccttataaataggaagagatagaaaacaattgggggatcttcactttatgagaaaaaacacattgtaaaaggttgacttgaaagaatatacaaaagttgtcttgttcattgattaccttatccaagcatacgtttctgattctttgttcacaagatccaaagattcttcaaccatctttatttctcctctttccacgctgatgtcggggaaaagagccatccgagtcttacaatagttgggcggtagattcctttttgttatattcattgtcattatctacatttattgcacatttatgttgttgcattcatgagcatttaatcagtacgaacgtattgattaacgttgtttatcttaccgattttacataatatttggtctagattttattactcttaactaagattcaccctttatctcatcattaattgatttaactaaaaggctcaacacttttagcggaatatttgaaaactttcattaatctagtgaacgagatgcaaattgaagaagaaactgcagcaatttgttaaattattcatcaaaatctacctgattgatatgatttttgtgcttgttcaattattcaccaaactctaccagattagtatgattgcaagcggcctatctgttaaatcattcatcaaaatctacgtgattggcataatttatttgtgttgtccaacaaattatttttcaaaattataatttgatacataacagtatcacaaaatgatagaactttagcaataaatattatattgatctgattactcacagtcaatatatcctatgttgctcggacactccaaaaatatcgtcgggtacttgtcggatcctccaaaagtagtgtatttttggaggatctgacacaggtacggaaacattttggagagtccgctcaacatagaatatatctactgattgctcaagcgtcaatatatcaacaacaacaacaacaacaacaacaacaacaacaacaacaatccagtataatcccacgtggggtctggggagggtagtgtgtacgcagaccttacccctaccctcgggtagagaggctgtttctaaataaaccctcggcatccttccctccaagaacttccaccttgttcttggggagactcgaactcacaacctcttggttggaagtggaggttgcttacatcaagcgtcaatatatcaattctgtgaaattaatctttgtaacataaataaatgtggcaaaatcatgactttttagagtagctgaagagctaagcctgagacagatatatatatatgctccttgtgcctatgaaatgatcaagacaatctgtggggaaaatttattttctttccacatttgaatggagaagtaacatcatattgcagatataatcatattatttgacaaatatcaaacatcttgtgcagataaaaccatattagagattgtagataggaagcttgtcctcagctgcactggtaatagaggtttttccctttaaaaagttggcgtaccagtatgcggaaagttttggataccttgttaattctttatcatccaaatctacatagtagaggccatagctcggtccatagccaccaagtaactccaagccatctaacaaggaccacgcaaaataccctcttgtatccgatccattcctgcattatatatatcatactatattataagtagtaagcctcaaggataaaattaaattactaaattactcattaaaagttaatcgactaatttacccttcaattaaacgattacttttatattttttagtactaaaaagtaaatttatctttccattaattgtagcatattatattaaaatgaaataagataaataaatccgtacatggccggctgcaatctcacttattacaccctatttaaggagttggaattcctttcctattccaatacttactgcaacctttagaatgctcggggcgctcgggatgctactaggaaatgtcgtacactatgttggcaataagtaatgcaaccagggaacgtagtaccttgtgttggcaataaggtgagactcttggtagtctgggatgctactagggaatgtcgtaccctatgtttgcaataaaatgagactcgtggcgctctgaaatgctactaggggatgtcgtaccctatgttggcaataaataatgcagccagagtatgtaatacctagggagagtgcacaaaacaaaagcttttagccaagtttgttataagaaagtcaataactttgttgtttaccttactgcgtcaagaacactcccaatgtaggcatgcaaatattctatccttgctgtgtcatttagtgtaccattacgccgagtcttttgacctgccaaaccaaatcattaagcttcttaaacacttttcacttcagaaagtcacaacattcccctctctctctctctctctctctctctctatatatatatatatatatatatatatatatatatatactgaataaggcaaaacaatgctagagcatacaagtgtaagaatccgcaaattgcgtgcaaaagcataaaatcaaaggagaggacgcaccattttcctgaatgtaaatcggcgggttgccataagcctcttttaagtagtccagaaattcataaagaccagaaggtatcactggatactaaagtcaaacaatgtttcagtgacagaacccgtgtaaattttgaaataacaacttatattagaggcttcacctgatctgctgccaatgcctcaactgcagcaactcaaaatacataaaattagtgaatatcatctaatccaccataagcacataaaataataaactatatatggaaaagataatcacgaatttcatacgtgagatatctgcttctatgtcagcgccaaagtccctggttttcttttcaatgctggaagagctgtccttaacagatgctgttgtatagtggtttacgcctatgaaatcaactgagcccttaactagcttagcctcatatttgctgaagcttggaattcttgtcccagcagccttcttcattatagagggatagtctccaaatattaaaggattcattatcctgcagccaaagtcggaaaaggaaaatattgcttgtaaatataaaaacgttgagttgtgtgtccatacaacaacaacaacccagtataatcccacttagtggaatctggggagggtagtgtatatgcagaccttacctctaccctggggtagagaagctgtttccaaatagacccccgacatccttccctccaagaacttcccaccttgctcttggggagactcgaactcacaacctctcggttggaagtggaggttgcttaccatcagagcaacccctcttgtctaaagcaaagcttaagttgttagagaaagcacattttcttgataataggagacgacgaacttgaaagcagaacgtctgtcgaattgtgtgaccactcatttaaacgttgaagagcacaggtttatattgtgtcttttaaaacaaaacctgtaatatcaagatttaacatgtcagaaatatcagccaatgaaattctaaaactcaccaaccggtataaaattcattagctctttgtgctgcatttacatcatccactgaatttgtgtaaggaacaaaccaaaaaccatatatactaaatcccacaaaaccatgttggatggactgcattgcaaaaattttgctgtcattacagtaatgctcaaactaaagcactaaaacacaaaatcattgagacttcaataacgatacagatgaaagttattttgcttctagattgaatcataccttgtaatttctcctgtacaatttcattgtggatgaatgtgcgagcaacatgttatgaacaacaatataaggctcagtagatgaattgcctctagaacaattaaccccaaaaggtggggaacaacgtcctggtgggatgatgccatgatcataacctccgatagcaaatacattggcctcattaatggtcgtccaatacaataccctgtcaccaaattccttgaagcatacctctgcatatgcagtgaagtccttcctaaagtcgatagcaaattctagagttaatcgtatctgatgacctgatactaaaattgatgtatgagtaaacacgtcaaaaatatatgctatagacatacacaatctttcggcttaaccatcccccgtattcatcttcaagtacctgtggcagatcactgtgaagtagtgtaacatgtggttgaatacctgcggcaatattaaaagatatgaaacacttttaatgcaggaatttaaaagtgcagttttttgcttttcttctttccctattatatgtaatcgacaagatgtagccaaatgttataaagaaatttggtcattaccttggctgataagttcatcaatgtaattgttataaaattgtaaaccctttggatttacaggtcctcttccacctggaaagagaacaaacaccgaccgcatcaaagggtatggaaaataacccgaggtgtttgcaacaggctaaacctacctggaataagtctagaccatgaaatagacaacctgtaggcttctaagcctgtctccgccatgagttggacatcttcctgcgatgaacaaaatatgcctttctttacgaaaaccaccaactttttacaagacataaagaacaaatcatttcttgaagaccataaactaaaaataacaaagacacttagagttagaggtaccccaaacctaagattatgctaatccgccaaggacttaaacaaataagattcaagagtaaggcttaaagagccagagacttagttaaatgctttttttggcatgttgttaagagaattgatggtatggaaccatttgttacatcacgttacttgattcatagcagtcagagggagttaaaggaatcagattgaaacagagttattgtatagaccttgtatttgtggtacagatcacatgctatgtctccattggctccactggaaaaacctggaagaaaaaacttgaaatatatatatgccaatctgcactaatctaactcgcagcattttttgtttcctaatagagtgattttaaatttctacaaagaaataaatgttccacatataaatgatagtccaaaagtagcatatccacttgatcaaatgtaaaactttcagtagtagactccactgccataaaaaaggggcagcctgtacaaaacatcccgtgcttacgcaggattcagggaaggggtgtgttgtagacagcgtaccctaatgcaagcatggttgcttccatggctcgtacctgcgacctataggccacacgaagacaactttaccgtcgctccaaggctctcattcggttactccactaccatagatgggaaaaaaaagaggcatttcaattatgcaattgtaaaagcatgtaacaaagtctccgccatagcatggtaaaacatcaaccgtgatgctcacgatggaaggcgctgataatttcggggtttggagaataacttacagtcttctaggatggcaagcttccgaaaaaaggatgcatatgacacttaagtcaatcccacatcggaaatgaagaagaaaatgaactgatatataagacagtacaagcaaaggtggatctaggattttaggaagaagggtgtactattacgatgaggtggatccagaatataaattttacgggttcaacctttagtacttactattgcagtattgcactcattatactttggaaattataagttcaaaactaatctcttttaatatagtaattttcttacatctatatttatactctgtgcggaaaatgttgggattagttgaaccgattgactatatgctatatcatccactactactagttttaatatacatatttcgtttaatcatataagatataaaaaaacaaaccagcatgagcaaaagtgtcccaaatgctaggtgtccttccatcttcaaatgctgccccttctaccttttgtcaaatataaacaatcaaagagtaaatatttagggagtattcatcaattaaaaactgaagaaatatttgaactgacttgataggcagaagttccagcaccaaaaacaaagtcaggagggaagtcagctctgttataatggtctgtaccaaagactatcaccaataaacattggattgaaacaagcagcagcaataaacagtagttggattgcacatttcggagcatcatttcgggtcaacacttattgtatctcttgacccggccatatatttgtaagttccactaaaccaacaatggaaagaatctttatcacttttccatagttacaaagagaagtgtatgatagagacattctccagcaagagagagattttaagtgttaggggtcgtttggtaagaataatgttacaacatgatgtatatgtagaggtgtctaacgggccgggtcagcccgttttcggaccgacccagaccggttgaaaccggaaccggcccggaccggtacaagggggtcgggtggggctggattaaaggggtaagggggcttggtccgttcacctattttcaaccggttaaccggaccggccaaacccgatcaacagaaatactgtagaaccggttaaaccggcccagaccagttaacgactagtttcattttttttttaaattgttgattgggcagcccagaccggttcatttccaaaagaattgtttgtttataaaaatgccctcataaccagtccatcactttattattttaaaagaaacatatgttgagaaatatttttatatgaaaaaaaaattaaaaatattatttgatttatctacctatattatagtatataactggatatttatttataaaaaaaatatatgctaattatttatttagttactagggatataattttattttccactttcttagattattttaaacttgcattaatataattagtatattttaatcaagcataaagtttgaaggataattttatctttaactaagttaatgcatgcattaaaattcattgcaattttaatatcatatttttttatacattaattatacataggataatatcaaataattaaggtgtatatttgatatctttattcaaagtttgtatcaaatagcccgaagaagaacgaaattgagaagaatgaagtactttattctcaatcccaagaattgcaccgagtccggaaccgaattgatgataaatttgacaaaaaacacatttttaatgttaaaaaaaaaaagttacttttctagtgatttcgcagtattttactgcgaattgctttaacggaaatttttccgttaagtcaattcgcagtaaaatactgcgaaatacaaaaaaaaaaaaattaaatgcatttcgcagtaaaatactgcgaaatggttaataacgaggcgtctctttaacagctgggccagggcatttttaaaagggcatttcgtagtattttactgcgaattaccctaattcgcagtaaaatactacgaaatgcccttttaaaaatgccatggtcgtcttcctcaacgacaaagacaccgagactccattaaaataaatttcttgctgcattctggtccccccccccccaccccacggctgctttaaaagaaaaaattcgccccacccgttccataaagaacaaggattgtaggtcccacatacaaaagaaggtttcgattccgtgcttcgggaggaaaatttcgaattcaaaaaaatttacatcgaggtatttctatttagtttatggcgaaactcgtatattcatgcatattagtattgcttagtatgtttacatgtgaatttatactatgtttgtgttgtttgatatacccggattgatttatttgatacccgaatttatgttatatttgtgaacaaaaatgctactagattgtttgtgttataaattatataaatattattaaataatgtataaaagatatgaaataaaaattaaaaaatttgaattcctaaaaatataatggagattgcatcgagtcaaaatataacaatatgcacacgtttggagaacttttagttggggcgggactactaaatattttcccaaatttatgttatgtgtgttaccaaaaaatgctaccggattatttgtgttatatttgatttatatatccgaattatttatgttattttttgaaaaataatgcttaaaatgtgataaataaattgtattcttatataatttgtattaaaattttaataataatttgtattgttaaatgatattaagcggtaatttaacaatacactgtggaggtgagttgtacctcatagagttattctccagtacaacctcaccaccccaatatagtgaaacccttattttttgtacttcagtcattgtaaaaaaggattgataagaagaagagagaagtataaatgtatgtttgccgttaagttgaatgaatgaaaataaaaatgcggacgcctataaataaggcaaatccgagcttcttgtatggaatgttacaaagaaattcgcagttatttactgcgaattacatttttcatttattactattttgtcagttcaattatgaagatacatgccaaaataaaggtgtaattcgcattaaattactgcgaattacgctaattcgcagtaatttactgcgaattacgctaattcgcagtaatttactgcgaaatatacctttattttggcctggatcgtttttaattaaatttaaattttttttacccatttcgcagtattttactgcgaaatgcatttaatttttttttttttttttttttgtatttcgcagtacttcactgcgaattgacttaacggaaaaaatttcgttaaagcaattcgcagtaaaatactgcgaaatcactagaaaattaacttttttttttagcatttaaaatatattttttgtcaaatttatcatcaattcggtttcggactcgaattgcactatgtttggagcctttccccttcaagaaattagagtaccaatgtgcagaaagctttggatatttttgcaagtttttgtcatccaagtccacataatataggccaaatgcctaaccatatgtgtctagtaattactcaaaacagtttaaaaatgaccatgtgaagtagcctttcacgtttgatccattcctagaataacaaagagatgtacgacacggacactattagaaatccggtaaatatattggtcgggccaattaccaaccaaaatgcgatcaaatactctatgacggtattttgaaagtcattttaatataccgatcaaagttggtcgaaattaccgaccaactttggtcggtcaattaaattttaaaaaaaaatattgcaaaaaaaaaaaaccgatcaaagttggtcggtattttaattatgtaaaaggttcaccatctaagaatcgaactaaggtgtgtactgtggctagatactattctaccactagaccattggtgcattttgttttaagattgtcttattttttatttatactctttaattgtattttcatacgaactttggttggttttattaaaaaataaaattatcgactaaagttggtcagttttttaaaatgaccggccgaatttaccgaccaaagttggtcgatttttttaatataaatttttatttattttaattgcaaaaccgaccaaagttggtcggtttctttaaaaataaattttgcgggactcaaaaataatttcccgcatttttgcgccaaagaaaactgaccaaagttagtcgatttcgtaaaaaaaaatattataaattaaaatattttgaaaaaccgaccaactttggtcggtttttgggtgattttttgaccgaccaaagttggtcggtttttcttgatcggtttttgccgaatttctattagtgggatatcatacggtttaaagaatctcacaagaaatacctaaacataaatttggtccaaataatacggaaaaataatatttcttatcaattacaagtcgagtgcaagatgagttagtgtttgatctaggcgtttaagcaagacgattcatgtaaatatgttacaggcctatatatagtgtctcattattaacaaatcgtgctgaactaaactacttattattttgacaagcatggttcaaaacttcaaataggtgggacagtcctgatggttcgaatttatttttgcgacaatgaatcagtcaattagagaatcaactagctcattcattgtaagtctatgagcccgtttggattagctggaaaaaagtagcttttaagcatatgggcttaaaagtagcttttaagtgctgaaacttgttttataaataagcagttatctgtttggataaaagtgctgaaacttaaaaaaagctgttgaagtgtttggtaaacaagtgatggtaagaacttttttctgttaaaaagacagaaatatccttaaagctgttaacattataaaaggacctaattactataatataaaacacaaacaaattatttttaactaaaaacacaaacaaatcattactctactaaaaatttgacggaagaaatgccaagtaggaagcagaacatgggaaagaaattaatcccaacagaaataaggtattattgttcaaaataatataaaacaaaaaaaattcctggttctgtgagatatttcattctgtccgcgtataacagttccatcctacacatcagtcacgtgcaacaaggaaaactttaaattgtagttgcaagacagcagccattaactacattatttgtaactcccccatctaatcaaaggagattcatactagtgagtagtggcttaacgagcagtgagcatacgaattagagtactactacattatttccattgctgagtacgacttgactacgctttctcactaattaagagaattagagtactactacttcggtagctgttcaatcaggaatagatgcaaaagataagaaattcaatgtgttgttgtcccaccatagccataactttagatgatacagctttcaacaaaaagccaaaatctactttaaaagggcttaaagattacagatggaaaaagtacaataggaagataacttactggttgaagaagctttcaaattggagctgaagttgggaaagttatgaagaagatgaagaagaaagcagaggcgctgctgatagaaaagagcgaccggtctttaggttttctagtggaggtaatttcgggaataagtaatattataagggataagaaagtaaaatctatggtcaaaccaaaatggcttttaagccattttaaaaaaagttgggtttagccaatttgttagttttggctttttttaagcagctttaggctttttttaagccctttttgtaattgccaaacacttctagaagttaaaaagggcttaaaagctggtcaaaccagcttttaagcccatccaaacaggctctatatattctcattattttgtttttgagatttaagattactggtgggatgaacgagtccggataatgaaaaaattcccgataaaaggttgtgtccctaaaatgagccctaggcaacgcaatctaaatcaatcgggccaattaatttcctataccatattgttagataagaggggttgctctgatggtaagcaactctcacttccaaccgagaggttgtgagttcgagtctccccaagagcaaggtgggaagttcttggagggaaggatgccgggggtctatttggaaacaacctctctacccaagagtaggggtaaggtctgtgtatacactatcctccttagacgccactaattgagattatactgggtggatgaatcaagttattgtacccatcttggcattgggacgaaaatatccatcttgagattgggaaaatgatattgtatagttgctattaaaataatagtcgaaaaatatatatttttttgtatttatatacatttggtatattataaataaaaattatatactttttctgctatcaaatataaatagtttctgaagcgggctaaaattaaaaaaaaaatttaaaaaaaagtccttttacctcttaagctatctatttcttcttttttaccaccaaatctctcctcaaagataaactatatgaaattagctaccacaacaaatgaaacaaaatagacttcaccttattttctaccaaaaataatggcttggtggggtggggggtggggggaggaataagtgttcaaaatcttgttcataactgttttgaggtagcaaagtttcccgaggaaattaataaatagataacagtgtgtttaatcccaaaaattctaaaccaagaaagtcaagcctattagtatatgtaatccagctacgtataaatatacggtataatattaatatcaagatcagtaaaatttgacaagtactaaggcttccctattttccacgaaaggacgactaaaattgggtttcaattcatatgtctggtagaactgctcttgataagtccaccctaaataccaccccaaaccaagccatgcaatatatcaaattttccgtttatattataaattctattgattgcattcggctaattttatttcgggaactactaaagtttgcaaaaagttgcatctaattatttggaatattattacgtacctcgtcgaattatttttcagtgattggtaaaatattattaacatgtgtgtaacttgtttaaattgttttttttctgtatttaacgtaacgtacttgcaccgagaaattttattttgtatttcatacaactgacactagttgtatgaggctcctttttatctcacaaaattgtggaccccaatcttacacttctgggtccacaaaattcggggtccacaaaactgtgagacaaaaagttacctcatacaactagtgtaagttgtatgagacacaaaataaaattttccgggattcttgaacctttaaaaactaaaattattctactctgggcatatgtcacttgaaaatttcatgagctactaattcttaatattttttggatattaaaatactatgttaatatattttatacaaagcaattcatgtaattaaactgttgatttgatggcttaggccccaaattgaagttgttcataatatgctgcatggtttagcatggtcattgatcacgcccaactatgccttataaaaggacaatgcggtcgttgcaaatataatccggtttacaagtccggagtcgaatcccacagagaactaaggcttagctacagatgttcactatcaccaagaagacaagcttgaacaattcctaacttatagatatttagattcttgtgtttaactaattaactaacaacctaaaataataaattaacaactaaagatactaagagttagagacaagattaaggaggtctagagttatgatttccccaattgtcggaatccttcccgctatgtcttctataatttcgcctaagtattctctaccgatcatgagcactcttattaccgtaaatctcttccgagtaatcacgacaatttactagacgcactctcccgagctacgctagctggcttataatacagctcacttcagatcgcacccaaggcttcgttattcctaatcccgcctttaaacccgcagttatagatccctcttatactttgggagtgatgttgttcaacaattacctaaatatgcactctcttccgagttatgcatactaaataggcacagctaattgagagctcttcaattaactacaacaaaaacgtagttgaacaaatagagaaaaactatggctcaattatataaaaacataacaagaatttatcctacaaaaggttctatcaaaactctagataacaaattagctattcataatagtatgtaaaactacaatactaaaagtcataaccaacaatgaaaaataggaagaggaaggaaaaaactcgttgaagaattccccgtcttgcttctattgtgttcttgactccttaggtcaaatctatgtcaaaaatatgtactctctaggtttaaaatatggcaaacgtatgtactctccaccaaaatagcgtttttacatgtatttataccaagtagggtcgggcccggacgaaataaccctttcccgtacgaagtgggactgctcagaggaatatggcctgccgcgccgcggccatgcgacgcggcagtggcctttgtctgcagcttgtatttttcttcccaaagtcaatttgtactgccgcgccgcggccatgcggcgcgcccacgcggcgcgatagtgagaattttcaaaaactcaaaagatgaaagttgtagccctttcgaatatctttccaacgatatattatggatcccaaacggagttctgagcgaaaagttatgtgcattttactagacaatacgccgtatgcccgctcgattcttcgtttgttctcaactatcaaatttgatccccgaacacgatcctggcttaattccttgagcttttactcagacttcaaagcttcaaatcacttaaattcattccataacatccatatagctcggaatcacacctacaaggcataaaacacacaattagcgcaaaacactagcgattaaagctcaaactcaattaaagtgcagtaaactcgagtgtaataagcgactaaaatacgtaattatagcctatcatcaacaccccacacttaaaccattgctcgtcctcgagtaatcaaactacactttttatagacacgacctttttaaacaattctcctaactcatcacaccaagagtatttaaaatatactaagcacaaaagcgtaacatcttcacctcaagatttgactcacaagtaccacgcattattcacaactcacctacttactctaacatagaggtcactgacattacatttccttcatgaatcaagtgccctcacacaacaaaaagagagtagttccacataataaaatttaagaacacttaggaactcaagatagaaagaattcactcactctcagaacaaatattcatatgccacaaaagatgcaccataagcttgcccgtagtgtactactccactaatcgagctccttcaatctaggatcaactaggactttattggttgtaatgtaggctacgggacgggtaggatacatttagatataagagtgactacacctccctaagcactttaatacatatactttaacattcaaactccatacttatatcaaaccaaactccaccttcacatcaatgtatattccccatacttctttaagcacacttacgtcacgagccaccacttatctttttttttttcttcacaataatccaactatatattttgttctttttcaattcaagtggctcttattattattttttaaaatagtgcacctttctccttattcatttagctccactcaaaagccaaaccgaccaccccacactttaacttttgcaaagttcgtaacaattcaagtgctcacgagaggtgaaaaggttcaaatagatggtaaattcaaacaaatgggtaaggcttgtaatgtggttgccaaagaaataagattacaggctcaaaggggttaactacgatacatcacaattaggcgggtaaaatatgtatatctggctcaacaaagaaatgcctatatcacttcctagactgaatacaactactatttcgctttgcaaacacacggggcaagttctaggcatcaaatgcaatgcacagaatacaacaaacctcacacacacatggcacataattcactcaggattggattcatggacactctagtcaaagcagttaagcaatttttaagaacatacaatttaaggtacttatataagagtcaaaaattgagcttaagcgtcacaaccaaagtacttactattctcaaggcataacaaagtcaagagatattgcttcaattcaaaatacaacacaatggctcctacttcccaaaaaaaaaactaactacacccggttcaaataaaacccttggaaaagaaccgtggtttaaagaaaaaccaagggggaattgctacactgcctaacaaaagaaaatctttttgtactttttctttagacttaaatccctcaagaaaattatctaattgatccatcgtcgggaaaagtccaatcttttctattttgaaaaaaaaaacaattattcaattactaacacaactaaaatagcatagaaagtcatccagacaatctccccaccccacacttaaaattgtgcattgtccccaatgcacaccataactaataaaagggtaaaagagactccctggtaggccaaaggccgaagcactaacagctcatggggtactcagacttctcccaagcttggtccttcgtgcgggtacctcacacttagttccaaccatttgatttgttattgcatccttccaatacctttgctttccatgctcctagagaaaaaaaaattgacactacaaaaataatacaattaaaaaaaataaaaaaaataaataaaagaaagcaataacgctgggttgcctcccaacaagcgcttgatttaacgtcgcggcacgacgtgaatcactttttgcctccactttgaacttatgaatcggaccccaagttttgattctgctctatgatcatgctcctggggtggtggaaagaatctgactagcccaataaaataatgtagtattttgcacttcttggcctttagatggggtgtgtaatcccgactttctggcaagaagaattccagaatgtaagcactttgttcctcattccttgactcctcaagtggctcggacgactctatttccatatcatcacctaaacacaatgtggaaaaatgcttggagtgaggaccaatgcgctcaactgcatgaacattgggacagtctacattctcaacactaatgacaatagagtcaactaaatatgtatcttcaatatccttggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcctgttatcctcacaagaaaacgtaaaatcatcataataaggggttgggggaagataagaaatataagcacaaccatgaaagtgaccatcttgaccaccacacatatcacacacattccacacataagattgagttggtgcacaaaactcgttctcgggaatattttgataattttgccaagggtggttttcatcacaatatgcataaggaggattaaaagtagaattaccaacatcaaaactttcataattccatgatgccatattttttttttaaattcaacaagtaaaacgaaaaaagaaaagaaaaataaatcaaatacaaaaaaaaatggttcaaacttgaaacctagcaatatgtacaaccacagctacaccgttagttccccggcaacggcgtcaaaatttgatcacgcccaactatgccttataaaaggacaatgcggtcgttgcaaatataatccggtttacaagtccggagtcgaatcccacagagaactaaggcttagctacagctgttcactatcaccaagaagacaagcttgaacagttcctaacttatagatattaagattcttgtgtttaactaattaattaataaattaaaataataaattaacaactaaagatactaagagttagagataagattaaggaggtctagagttatgatttccccaattgtcggaatccttcccgctatgtcttctataatttcgcctaagtattctctaccgatcatgagcactcttattaccgtaaatctcttccgagtaatcacgacaatttactagacgcactctcccgagctacgctagctggcttataatacagctcacttcagatcgcacccaaggcttcgttattcctaatcccgcctttaaacccgcagttatagatccctcttatactttgggagtgatgttgttcaacaattacctaaatatgcactctcttccgagttatgcatactaaataggcacagctaattgagagctcttcaattaactacaacaaaaacgtagttgaacaaatagagaaaaactatggctcaattatataaaaacataacaagaatttatcctacaaaaggttctatcaaaactctagataacaaattagctattcataatagtatgtaaaactacaatactaaaagtcataaccaacaatgaaaaataggaagaggaaggaaaaaactcgttgaagaattccccgccttgcttctattgtgttcttgactccttaggtcaaatctatgtcaaaaatatgtactctctaggtttaaaatatggcaaacgtatgtactctccaccaaaatagcgtttttacatgtatttataccaagtagggtcgggcccggacgaaataaccctttcccgtacgaagtgggactgctcagaggaatatggcctgccgcgccgcggccatgcgacgcggccatgcgacgcggcagtggcctttgtctgcagcttgtatttttcttcccaaagtcaatttgtactgctgcgccgcggccatgcggcgcgcccacgcggcgcgatagtgagaattttcaaaaactcaaaagatgaaagttgtagccctttcgaatatctttccaacgatatattatggagctcaaacggagttctgagcgaaaagttatgtgtattttactagacaatacgccgtatgcccgctcgattcttcgtttgttctcaactatcaaatttgatccccgaacacgatcctggcttaattccttgagcttttactccgacttcaaagcttcaaatcacttaaattcattccataacatccatatagatcggaatcacacctacaaggcataaaacacacaattagcgcaaaacactagcgattaaagctcaaactcaattaaagtgcagtaaactcgagtgtaataagcgattaaaatacgtaattataacctatcatcagtcatatatatggtagtgggagctactcctctcaactctcaattttagatgtgaaattaaatagttttataattaataaaattccagctttgcccctcttaaaaaaggggatgagggtttgtcggatgttatttttgaggttttattaacatgctaaaagaggggttgctctgatggtaagcaacctccgcttccaaccgagaggttatgagttcgagtcttcccaagagcaaggtggaaagttcttggaggaaaggatgccgggggtctatttggaaacatcctctctatccaagggtaggggtaaggtctgcgtgcacactaccctccccagaccccacgaagtgggattatacaactgagttgttgttgttgttgttgttgtgttaatttgttacaaaaccaaagagcacataattaataggtacattaattttaccatgcaataaatattaatgtagtcacaaatataaaaaaatatcattttcttgactatcttaaataaataatatattaacataaaataattaataagttcaattattaatataactgttatgcttgctcatgttattctaatatgaaaattatgatttgttgtattttttaaatagcaaaaagataaatatgagttttaaatatgtttacaaaatgcatcctcttgggatttcactgaatttattgttatttatgtttccaacaaagaaaaataactactcgtcctagttttgcctattggtgtttttcttagtttaacaattcctttttctagataagagcctataccataaattgttttcttttgacggtgaaaagctgcatgcagactgttaggaagaggaagggtcgggggagggggaggatataaaatccgagtacgaatttaactgaacccaataatttttatatatatatatatatatatatatatatatatatatatatatatatatatatatatatatatatatatatatatactactactactaatctcaaggtacggcgttgcgcgtgtatcctataataacgaaaattattttaaaaaaatagaaataatatttaaagcatggttttagtcacaaaaaaaaaatattaagtaaaaatttgagtccttgaaaatgataaatattgatcatgaaattgacataaatataaagaattttattcatttattcatgatcttgtctaataatatttatttaagtaccaaatcaaaattaacgtatataaaaaaaattattagtaatttgaaattagaatatcttatgaatattgcttttgtcttaatagccatgtatattatgatttgtcatgtagtaataaataaaaatggacaattaagttaatactcttatcataatattataattgatttcaaagatgtaaatattaggaaaaattaaatgtcaattctgttcctatttgaaatttatttttaaggatagaaaggtttatcaatatttcgctctgaggctttgtgcttttataatagttgatatatatttttatttattaaagaaatataaacatgtattttgctcgcaagaaagaaaaaagattgtctttgtctaaatgaacttgaaaatagcttttcggttgttttagaaaagctcttaaatcttcaaaaactatgtattcttgctaaaactgaaaagttgaatatatagaacttaaacaaaatttaatttgaacgtattgaattacgactggggaattttatagcgtacagtttcttcatttattgagttagctatatattggatcaataatcatcaatttcataaaattaaactttctattttatactcgaatataacttttagcaagtatatttattgaaattgggtgcgcgcacacgctacgcacataccgtaaattttaccaaataataaagactcctaaccaaaaagataattgctatgagattaagagggtgtttggctaagcttataagctggtcaaactggcttataagcacttttttggcttatctacgcgtttggtaaaattaaaagtgtttataagttaagtgcttataagccaaaaacgataagctggtatcccccaacttatcaaatttcagcttataagcactttaggtttgaccaaggtatttactattctatccctaaaatacttctttttaaaacaaaactcttcatatacccagttcttcagctgcttattattaatttcagcacttttatccaaacacgcaagtgcttattttttaaatcagcttcagcacttaaaagtgtttttcagcacctaatgcttatcagctactctatcagctaagccaaacgggctctaaaggcaaaaaaatttaatcaaaaaaatctcctaaacctaaaaggtattaactacaaaataaacacattgaatactccatcatagggagttaaacgtaggggcgaaaacttaggctaggcagaaattttttaactacaaaaaaagtcttcaaaaccttaaaggtattaactactccaacgtagggagtacaacgaataggaaaaaatttaggcaaaattttattaactttcctagacgattaataatatgagaataattaaataggtttccaaaattataggagaattaattaagtaattatttctaaacattaatgaaatacttaaattactattttgtctaatgtgaactctatattttaaagggtaaaaatggcgaacgatattttgctaagggccttcgtgcttttaatatatatatatatatatatatatatatatatatatatatatatatatatatatatatatatatatatatatatatatatacccataatgtttattttataatgagtcaaaaattatacaaattttatatacttttttggctaccaaatgtaaataatttctgatacagactaaaagtaatataccccaaaaatataaaacattgaacccatattcaattaaaattctggattcaccttggggttccaaagtcacatagccatcaaatcgggtattatatttgtgagtgcgtaattttgcctatgtgaaattactcctaaaattccccaaaaacgggtttctaattagttttgatttttatagaatttttgaagatttttctccatttgttgtttgcatttcatgacatttatttgcatttttagcataataaggagcacttccaatcagaaaatatcaaaaaaaaaaaaaaaattattattcattctttacattttttacacttagttgcatgaaatacgaaaatcacataaaatatattaattatttttgctttctgtatttttagtttcaattaattagcaagtttgtttaatcacaatcttaattaaataattagtcaactcctagatgtagtagttaaatggtttaacggtgtaaattggattcaattagagtaattcgctaaaagtggccattttgaacaaagggaagaaataaggggtttgttgttaaacatttaggatcaaaatttgagcctattgttttcggatgaaatttaaaaatagccagatttagcactggtcattgaaaaatagccacgtttcaaaagtcatacaaatatagccactttttatgtaaagataaatttgagcgaaaacactgttcaaaactcaaaaaatacgccagtatattatactggagttccagcataagtatgcttgaactccagcatattatactggagttccaggataacagcataagtacactagaactccagcataatataatggagttccagcagtataattgtccagtataatatattggagtttagagcacgggtgctccagtctcccgtatattttacaggagttggcaacttataccgatccagtaaaatatgctggagttcgtacaaaaatacactagaactcccgtatattatacgggaccggtcctattgcagcaaaatagtggctattttttattgacttgctaaacggtgactatgttttattaaccagtgcgaaaactggctataccataaaattttatctattgttttcgcacagatcactcaacacgtccaagcccgcatttaaatccggtccagtcccatcccaaggccaacgacgccgttttacctacagtaaatccaaaccctacatctccataaatctaacggctgggaactgtttcttcatcctcatataagtgtcgaaaccaccagacccccctacccaaagacgctctctcacgcctcatttgctctccacatcattcagccgtcggccaccgccgtaaatcgcctcacggcggcggacagtctcttaatggaccaaattttcaccctatgatttccagcacatcctctttctatacccctagcctcatccttctaaacctttcgaaatttcagttatagcagatctaggaacctaaattcatcccctttttaatttcccccaaattccagcctattttgattaaataccgacaccaatcgacttctcccgacgggtactaccatttcacggtggtcttggttcgttttggaccgtcggaaaacctagctgttcctgtttagattttgttttcggtcatttgggttcgaaatcgacatcagtcgattgctcttatcttgataagtgcaatcgattgatgtcagtttttgactcatcacttgaccaccggagtccgatcagattttgcccctgcttttgtccgccatttttgcttcgatggctgtttcttaagggtaaatcggtatatccactcatttttcctattcgtttgttgattgtgcctttttttattgattaattacattttaatttttgtttgcatgatcaattagaatagttaataggttgggttaggttaattaaagagtcagcatttactaaaatctttgtttataattagagttcaaaatatagtatttgctgtgttgattttcttttgggctttctcctattgaagccggattgggcctgtcttgggccatggcacttggcccagacctgatcagagagagtgaagtaacacgtggcacttttcagttgcaaaatattccctcccttctcatttccggtgaattattcccctacctctctctgttctaacacctatatatacactccactccctcatttttcacagacgggtcttctcttttactacattttttctaatacactcacatacatacttagaactcacagaaaaaaaaaactgaaaagaaaaagagaatttcaaaaggaattggagtttctatcattctgtttcaataatttctggatttttgtttggctttgggtttaaagttggagctgtgtggttgattctgcctggttgaactcttttcagtgttgtttctgcagtttaggtcagttccaagtctcttttgtatcattttctcattgaatgaccaaggatgcttaaacgtctcctgcatttgatttgctcaaatcatggtttcacattgattgtttgatttcaatttgggtgaaatagtgcgatagcttaaaatgatgtatttatatattttcagttaaggatttttgtgaattttagctaatcatgctgattccggttactctcatctttgctccagttttagtatagaacagaacctgtttttctgatataatatgtcaattaggatatgaaattcatgttgttaaagtcagtttgtgctgtatcattgcttgagttactcatctgtttgttaaatagaggcattctgctaatgaaggctggattgggttattgatgtagcctctaattggctacatttgtcctttcaaatctatatggaattatgaaggctggattgggttatggatgtagcctctaattggctagatttgtcctttcaaatctatatggaattacaggagttttcgcggtacaaaatcagctctgttgtgattaatttcagaacgaattaatgtactttgctatcacattatggatttattttgaatacaagagaatggaggatttagatctgaagatcactttggtttaacatctgttaaatgaagtttaggtggagtaattgttgatatgtgaaggttgaagaaatagttgctttctgtgtagaattttattgttaaagctggagttcatgtaattcgccaaagggcttttgttataattttgtgttttaacataatgatcgagtttatgatttatgattttattaattaggaactgatgataacattaagtaatctatgcttgtccaaagattttttgagctatgaaatgtgactggattcgtgtgagtaggaatatgtgaatttagccttccccagtttgggcctgttaattggcctaacaaggcttgcgtgcccaatttgggaatacaacggtttccacacaaaatagggctcaattgtaggccctgttgaggtctgaacgtgagtatttcctcatgtataactcacgatactgtgaagccaactactaaaatccatccgaagcatttatcaactactaaaatcagcagtttcacgtcaactagtccttagtcaatacttgaaataggaatattacattcttaatccgatgtttcggggttaagtgttagaaatgaaaattctttttgttacagaacacttttccctttatggatttgtcggtcccaaagcgaatactgaacatcgcatgagaaacacaaagaaaactttctcaatatgctaaagaatagcatcctcggagtttcgaaacgtgcaagatgctaaagctttctcaatataaataccctggagctgcacttaggaaactggagctcaatgccttgaattgaaagtttgaaaaagttctgcatcagagtttcttttagtctgaaaaaagagcaatgaaaagaaaaactacaaaaatatttcaactttccttagtttgattttactttaattttcccttttaagaacaaaaattgaaaaaaatccttttgagatgcagtagagttcgtttttcagtttgggtttctaattcgaacaactgagtggtgtttagacagtttcttgtttgagttgttcatattactttggctccgaaatgtggtcgttagaatctgtaatgtgataatattgagtgttgctatgattgtatgctgttttagtgcctaaatctctttgttaaaattttttataatggattaaaatgtgggaatatttatcttacagttcccccaacaatgaaggcggaaatcgaaacaaagctatggctctctttttttctggtcatgtacacagccatcacttttcttctgtttgctgatggtattttggttcagcaacatcatcatctcgagtatagtatcgttgcatttagtttcatgttgttctttggtttgatgggggtgggtttccttttggaggatagggagcttccgattctagaaaataggaagtatgtcaagtactgcaatctagttggcccagtttcttgtatctttgttgttcttttacttcatgatagacagcctatcggtgattgtatctattgggtgcttctttgtgcaccgatgggctcattttcccttattatgatgctgaggcccgtcagtactgatatgggatcattttatcccttctgcatactgacatttagtatctcgctgagagactatcactattcctggaggacttgggctgccatggcactatccctattacttatgtttacgagagcccatatggagactcgggctatttctgctattgctgcgaggtattgacgtaaatgaacctatgtgtttcttttctgtattttgagttagtgttaaatcttaattttattacttttgtaggaagagggcccttcgtgatgctgttgagggcccttcgtgatgctgttgagactgagacgtctactgctgatggtgctgatgcttagtggtgctgatgcttagtggagttatttagggcactacttagaaaactgctactttttaactttgttaattggcttccatcatgtccaagttttttttatcgttagaagttgtacataacaactcggtagaggttgaacataacaacttgattgtggacgtgtggtcatttaaatgtgcccactgatcctgttggaaattgtttgtagtaaatgttttttccttttctctgttgatgtacagttgatacggttatagagtgatatggggaaaacataaagctaaaacaaatgtgtgtgaatcaaagactcattacatgacaaaaaaaaggaaaaaatagctcataatttataaatgtagacgaaattagtcctctacaaacaccttcaaatcaacaaggcagctccaactcctttttacgatgagcaggtatttcaggagcacgatatgtcatgtatctatagacagataaaccaaagcagaagctcaaaactaaagctctaactaacaattctacgttcaacatgtaaccaagaacctgcattactaatcccaacaatacgtctattcccccaatatcatacgatatgtgtaagaagtgggcatagatatagaaatatgtggtgcagctcactaatagagcgagatacccataattgaactccaaaaggtgatgcagggctgctgcaattatcataggaatgacctcgatcataaatttcgccttggctccaattaactgaaaaggcatgtcgcgatgccaataaatgaccgtgaaaaacgcaatcatatgaattatacagcaacacatcgggacaatcgtctcaaaaatcatggagatcatggaaacttttggatcacccattaatagcacgaatgcagcaaacatgctcagcgtggaaacattactaaaatgaagccaatatatgtcattacgctctctgagaagccctgaaagaaacacggaaaaaacatattcagcatctcaaagaaagttaaggaagtacaagatcgagcactccaagactatgaaccaacacaattgtagaatgcaactttgcacccaaaaaaaaatcaccacttcaaagtccataacagagaagcaacttctcgtctcaaacaacaataacaactacccagtaaaatcccacatagtggagtctgaggagggtaatgtgtacgcagaccttatccctgcctcgatagggcagagaggccgtttccgatagacctcgactcagaaagacgggaataaagaaaaacaaagaaaacaagaaaagaaaagagaattcattagtaactccagtaaaaaccgttatagtaacagaagcataaaaaccaaaaaataaatgacatgcaataacagtaaccagagtataaggctctcatctcaaacagtatcagcaaaatacattatggcattaatctgccacccaagctaggaaaacaccgtataaagctagtcatctttatttgagcatggttaaccaggatcttcataagcgacttaggaatagacttgtaacaactgacagaactttattttaaaaagaacttcaaaggaaatcctatgaccaaaaggtaacggcagaagcatgcacctacgcgatacactattattaccttcgctcacagcaaatatcataagttaggggtaaggtcaacgacaagactataacacactgactacattgtcaaactaatacattccttccttaagttccagctctcttgtacaatccgaaatttgtccaatagtgcactagagaaggatttgtacccccacacgccctgctagtattaacactaccaaattaactatatgttggtatgagatatatttcaaaatttcaagtgaagaacgccaatctttaggtaaaaaagacttactactactaccggttgatggaacatagtctttatccggaaacaccctctttatcttattgaaaatggaaacgacagtcttcaagctctgcctgcccttctcacaggtaacggttgcaatgtcgagggacaagtcaccgggagaggcacacagaggaagaacatcacccatatggttgcagttagatagatactactttcacagattttaacagctgcaaaaaaaataaaaaaaaaatacagtcaatcatctctataatagcatactatataacaataattcactataaaagccaagcttttccggaaccaaatttcaacataatggagtatatgttatctataacaccattcgctataacatccaaaaaatatttgaaacaaacgagactgttataaagaagtttgacggtaaatgcagaataaggggcaaacaacttgaccaatttatataataactcaaatgatcatacagatgaaatattcaccattcagttagagatttatgatccgaaattaacttcaaaatcaatcaaattaccaacaacagtaaaaaaataaaagttccaaactttggaacatgttaaataaattacaaaaaaaaactaggaaccaaaggttgtattttgaatgtaaaataaaaaagataaaagtagttgtccaaaaatattataaaagagcatagaatcaatgataccagttcggaatatctattgtagggtacaattaattcttataattggacaacatgttaaccaaattatacaaattgcaaaactatgatttatttatttatttatataaagataaagaacagaaattgcataaaccataaacctaggttgaacatttttatttctttcaattttatattcatttagttcttgagccgagggtctttcgaaaaccgcatctccaccctcgggcagaaataaggcgtgcgtatacactaccctcccagaccccactagtaagatcccagacccctagtaagatttcactggagtgtcgtcatcattgttttatgttcgtttagtgttttcagactgaaaattttacttgggcaaacagaaaaattatacaaattgctaaaaaataaaattaaaaattaaaaatatattgaattaattacctgtgtcgtggactaaacgatcaaaacccagcaacctgcaactgttgagaatgttaaaagagggaaacgaagaaagctgttgagtttgttttgttcctttttgtaataaagtgtgagaaaaagattgtagatttgtaattttgtactaacaaaaaagggttcagatttaaatagaagtgaaacgtgtcatcctatgaaactggaacaatattggattcggattaacaatcctatttaggatatgagtattctctaaagtccttttttttaatagggttaaaattaaaaataaaattttatgtattataaaaattacaaataaattaatatatttatgaaaaatatatattcacaaaataatctcataattacgtaatctcgtattataactctcatattacaatttcggtatacacagttataactaaaaatttgaagttatgagtttagaattttaaaaaagatagtagtttactgtgttttgaataaattatttatatatattaaacagttttttaaataaaaatataagatatgagctaaatctactaagtttttcagtataacttgtccgcaaaccaaacaaactttagggaatatttggtatggtatattagaagaaataatcatggtgcaaattctgtacttagttatcgagcatgtaactttgacaaatttggaatatataaaatgatacggcatgtaatcacaaataaattttaaagaaaaataatactccatatgtttcaatttatgtgaacctattttttttaatccatataaaaaaaatgacccctttttatttttaaaaataatttaatacctttatgtaatgatttataaattatcaccacacaaaatatgtgtcactgaaaatttatggagctactaatttttaatttcttggatattcatttttattgttcaaatattgaaagagacgtacggatgtctgctaaaatagaaatatgctatgttaatttgcaacaaaagcaagaggttatgtatcaaatcactttaaaaaaataagttagggtgcaaattgtcaaaagtcaaaactataacacatcaggataatcaagataaaaacaataaattaacacttacaaatagccacgcctcgcatgcctttgaagttggaggaaattagtccaaattcattaacatacatagtatcatactatcattaattttatctaaatattaattatagagcaatcaaaacggtctagctcagcccaagctttgaagttgttgagctaggactgttcagtccgccatttgaatgggtagtaaaatggtcagcccagaccagttctaaaaaggtcatgagctaggataggccggcccttcattttctttaatcaatttctttttcaaatctttaagaatttctttgtgacataatcccctaataatgtgagttacttacttatatatatatatatatatatatatatatatatatatatatatatatatatatatatatatatatatatatatatatatatatatatatatatatatatatatatatatatatatatatatatatacacttattagaaagaggaataagcaggcaccagatcaacatgcctgcttggcacctgaagggcgttctggtaatttcgatgagatgaaacaatatgattggataaaaaggcatcttacttagcttccatataaatatttgagtgattagactaaatcgccccatgcttatttcagcatacatcaccatattatctaaaagcttttctaagacgtgggtcccaactgactatttgtttaccattttgctagagcaagaatccgatagctattgtacaactctctgaaaattatggctgtcaagttcggcccaagcccaaatgacccgcccaaggttgagttggttattgacccgcccattattgaacttagcccatcttgacccaacccatctcaacccaattaaagttgggctaatttttagcccaaattgatccatgagtgtgtttctcaaaatatcttagaaataattttttttaatattttaaatatgaccataacaaaagcaaaaaagccttatttagtaattatacaatttgtaagaaaataacacatattaattaaagttggcgaaatacataaaataacaccaaaccttgtagtcaaatccctcttacacacctgataactacgggaatataattacacacccaaaccttttaaagtgtgtctattatacaccactttagctaggcagcaccttgtgtgtcctacacatgaatcaggcgcgagaatagaaaattttaatagaagccgcgtgtccaactgtttcattttttaattttgtcattttttcaattgttatctctcaccttcattatccccatttccaaattcaggcaaacctccattgtgggtaaccccatttctactggagtttgaatcttgagttgttaaagtgatattggatcttggaagttgattaattaactactttggatcgagtaatattactcactcaaaatttctaatttgaagagtaaaaaaaaaagacgtaccattgaagaagccttcaattgtactcttatttaaaaacccagatttgaatctggaatgtattggcgatttattgttaaaaactgatccgggaagtctaacatggattaccatgtgcacttcactaaatttgagtctaaaaaatataaaaaggaagatcgatcgtcgaaaaatatggatgtcttgctggaaaatatgatattcttgtcaatcagtgcactttttttcttcctctttattccccctttcttccaaatctgtccaaattttctaactcttcaaattcgttttttacaaaagctttcaagtgattcaaaacttagagaaaattttaatttggtagaaaatcaactatcgggcggggaagattaaagaaccggggaagggacttggggaagatgatgataggggtggaggtgaatttcttttttttttctctgaaatattatcatctggggtgtaaattaggtccctttttttcttttgaggtatgacacatgtcacactctgattagcacgcgtgatgcaatttttaaaaagaagttgtcaaatacaaaagtggtgtgcaataaacacactttaaaaggttgtggtgtgtaataatattattgtgattatcgggtgtgtaagagggatttgactacaaggtttggtgtcattttatgtatttcgccattaaagtttaataagagttgggcgggttgagttatgacccgaattttaacctatcttgacccaacccatcttatcccaagtaacttttaggcgggtcatttgacctgcccattattaactcaacctattttgatcctcccaaaattgacccaacccgcccatttgatacccctactaaaaatcgtggagcccatttaataaccacatgctagtgttaatttaatgtttaccgagtgttcttatccatgcattaaattatttgtaacgactcgaccagtcgttttgagcttttgcactttaatcgccaattctcgtgcatgacttgcctcgtataatgtattatgtctgatgtggatcgttggttctgggttttcaggaaaatcgaaatgaatttgaaagaagagtctcagttgaaagctttgaatttgaaatgtttgaccaagagttgacttatttgtatacgagctcggatcggagtttttatgatttggttagcttcgctggatgatttatgacttaggagcgcgatcagaatgcattttggaagtccgtggaaggatttggcttgaattggcaaagttagtattttggcgaattccggtgataggtgagattttgatccgggagtcggaatagaattccaataggttttgtagcttcgttatgtcatttttgatgtgtgtgcaaaatttcaggtcattcggacgtcgtttggtcaggtttttgatcaaaagtgtatttcggaagtttttggaaaaacttaggcttaaattcgatgtgaattgatggttttggtattgtttgaggtgttttggtgattggaacaagtttgagtgaggttttagaatgtgttagtacttttggttgaggtctcgggggcctcgggtgagtttcggatggtcaatcgggtcatattctatgttgaagagttgtagaaaattggtctcagcagttgcaacaatttatctcttcgcgttcgcattagtgttctcgcgttcgcgaagagtaggcggaggtgggtgtgaaattttcctgcgcgtttgcgaggtaggcatcacgttcgcgaaggggtgtgatctcagtgcatcacgttcgtaggtttttattcacgttcgcgtagaaggatttgagttagtggaattgtgctacgcgttcgcaggtgtattgtcgcgttcgcgaagggtcgctcaggaaaagcatagcattcacgagtcccgtatcgcgatcgcgtagaagggaaatctggtcaaggtaagatgtgcatcgcgaacgcgagagttggaccgcgttcgcgaagaaggattccagaactcggcagaatgttataatttcatttcctctgcgattttgggttatttttcctccatggttgatcattttgacagcttcttggtggagattaaagagggattcaagaggaatcgtttgaaggtaagatttttgaacttaaaactcgtttttattgtgaaatccacctagaaattcatggaaactaagacaaaaagtgaagaactagggcttgaaaaattggacttttgatttgggatttgaaaggccatttggggtcgaatttggaaaattttgatatgtatgaactcgtgggaagataaggaatcaaatgatataaaaatttctgagtttcgagaagtgggcccgaggctcgggttttgccaatttcgggaattttggtattattcgattatttttgcttgggctttgttcccttagcatattgttatgtattcgttgtgattatggatagattcgatgcgcgtggaggtcgatttgaggggcaaatgcgtcacgagctagagattttgccggttcgaggtgagtaatgattgtaaatgatatcctgagggtttaaaaccccgcattacacatcgtagtgctatattgaggtgagacacacactggatgacgagcatgggatcttttaccactggggattgtgacttggtcagtcccgattgatgattttaccgcgtatttgactgaaacttgtttgttttcatcataatttgcacttattgccatatttgggcttaatgacgattatttgaatccttcatggacttttatcattgttttcctcactattttgacgtactacttgaaatcagtcctattaatttacactattttacaaactcagccacttttacttgaatttgagacttaaatgatatttaaactgttgtttgggctgagcactattgtttttactgatgcccgagggggttgtgatgattttcggactgagtaaggctgagggacatatgttaggatatgctaagtgatatgaggtcgagggcctgagatactttatatgccacgaggtggcttgagtgatgtgaggccgagtgccgagtgatatgaggccgagtgtctagtgatgatgccacgaggtggcttgatatttgcgcttcgaccgtaaggggcccctcccggagtctccacacccttagtgagctccgtcgacgatatatggatcgggctacacgccgcagcgagatgtggatcgggctgcatgccgcagtggttactatatgatactattctgagagttatctagagagaaatcccgaggggctgagagtgttctgagagtgagcccgaggggctggtactgctttgagatattgcccgaggggcgaacttttatgtgctcattttgcatacttacttgtcttttacttgttatactgtagtatttgtgcccgatgggtggatttttgtgcgtatcggcactaactgttttgaaattatttcgcaactgtttaaaagatcattttcaaaagaggtgtaaaactgagccaagatatttctaaagatttcacagctttactgattttctcaaaggatggtacaatgtttctataccatatgttgattgctttaagtgatttcttactgctcaattgttatttacctttattactcactgagttggagtactcactctactcactgcaactcgtgtgcagatgcaggtacttgttcacccgatagcgggttttgaggtgataagaggctaaattaacggagtttagcgaggtgactgccaacgttcgcggtaccgcatgttcttcccttgtttatcagtcctatttgtatatttcagaccttgtagtggtagttatactctaatagatgctcgtgacttgtgacaccccggtttgggctgtgttggggtgtacttccgctagttaatgtcattatatcatatttaaactgcttatgaattgtttaactgcttaaaataggtgttcagtaatggtatggctgaccttgtcttcacgagaggcgtcatcatgaccggaacggggtttggatcgtgacatcatttgactggagctattatttgatgtaaattaaaggtttgtaattacgtagaaatacttaacatgattacatgaaatttttatcttatcttacattaaaaaaaaatcaaaacttttcgtgatttgttatgcaatttgaaagttttgatgtgattagctttttaaatagtctttatcttaattacttgcattgctttttgaatagtgaatttatttacttaaaattaatttttctctctattttaattttgtatgtctttcaatgaaagagataattagaagatgttttatatcttttttgctttagatgaaaaattacaagaatatagtaaatatttcaagtatgatacaatttatttgtgacgacccaaagggtcatcaccgtaattctcccttgctccgtgcttctgtggcctcgaaaacctcttgaggggttgcctcgatttgcgtgcgcagtccgggcgcgaagccagaaaagctttgatgataagaaatttgaattgtatgtttaaaatgataaatttcaagtataatattgatatggttgacttcggtcaacattttgggcaaacggacccgaacccataatttgattgtcttggaaaattcgtaggaaaatatgggactcgggcgtattcccgaaattgaaatccgaggtcccaagcccgaggaaacaatttttcagtttaattgattgctgttaatgttaaacgaaaatgaatttgaaaaatgaccaaaaggtaatggtatcgggcttgtattttggttccgacgcccggtacaagtcatatataatggttaagcgttgtttgtgaagtttcatgtgaatcggacgtcgtttgacgtgtttcggatttgaatatagaaatcctgagtttcatgtgttaaagagtgaaattgtgattttggggcttaatccattgattatgatgttattttggcgatttgatcacacgagtaagtccgtagggtatttttgaggtagtgtacatgtttggtttggaacccgagggctcgggagtgttttggctaggtgtcagatgcattttggcgtggctggaattgcagcaggtgcctcagacctacaggcttctttcgcatttgcgaaggggtccaattccagccaatctcgcaaatgcgagtttgacttcgcaaatgcgaagtcccccattttcctccggatatcgcaaatgcgagtttgacttcgcattgtcccccaatttccttcctatctcgcaaatgcgagttctacatcgtaaatgcgatgtccccttttcccaaccccaattcgtaaatgcgaaattaatgtcgcaaatgcgactttccccttttcttcagccacttcgcaattgcgaagtttttctcccaattgcgagatttccatttcttcagcccacttcgcatttgcgaattgtttctcgcaaatgcgagattccccctttggccagccatttcgcaattgcgaacttaatctcgcaattgcgaagtctgcacctgtgtaaaaattacttaaacgatttttgaagctcatttcgattatttcaaaacccaaaatcctcttggcgattttctctcaattctttcttctccaattcgattgtaagtccatttttacttgttttcttcaatcatcatcatcatctaacatgatttcatcttaaatcaaagcttttcatgggttaaaaatggagatttgggtagaaactagggttttcatattttgagcttttggacctcgatttgaggtccgatttcattctaattatagatatgagctcataagggaatgggtaacccgattttggtccgaacctcgagtttcgaccacgtgggcccgggggcattttggaaatttttgggtaaaattttgggaaactcattcttatgtattcaaattagtttaattagcatttgttaattcatttgggtaatttatgattagatatcgttgtttgggagtcggattctagaggaaaggcggtgttagaggcttgattgctagtttcgacattcaagtaagtgtttgatctaaccttggcttgagggaataggattagggtattgcttgctatgtgctacttggtgtcggtgtataggcatggtgacagttatctatgtacccgagtctagtatgatcgtgagtccttacttgttctaattgaattatacctcccgaattcttggattgataagcatgattagtaaggtgtatagtcgaatataagtaataatttgtgtagtttgggagctttggctcgacttggctttgactgattgatgaagtataaaatggttgtagatgtgatcatatccctcgtcgggatctttagtggcatttatattcttttcccgttacgaattgatcgagttcttatgatttagcgagggagagtgtttatgcacgatggttccttccgtgccatgatattgaaatgtttatgcacgacgggtctttctgtgccatgttattgaaatgattaagcacgacgggtcttaccgtgccatgatatgagagtgtgggaggatgagaagcacgatgggtgttgccgtgtattgtttgattattgttgtactgtttgaaagtaaaggcaactgttttgtatcgtaaacgacatccctgacttctctgcttaacttgtagttccgtattacgttcttcctgattagttttgcctgttgaactgtttttccccttatcatttcccctcccgttaagctatttaagttcctattttaattactgctagtatgtatagaactgtattattgcacaggttgatttgaaagtaggtcctgtctagcctcgtcactacctcgtgagccggggttaggccaggcacttaccaacacatggggtcggttgtgctgatgctactcttgctgtgcctttttgtgcacagatccgggagcggccttcacccagcagcagtagcagtagtctaggagcgcgccttcagtccagagactaccaggtagatcactggcgtccgtgggcccggagtctcctcttacattagttatttggtcctttgtatcggacgagtactaaacattgtatttcttctttcaatccaatggttgtagtaactctttagacagtccgtgagcattgtgacactacttttctgggtagaagtttgtagacagtttcccgttctgtatttcgctttatctcagtattatactatgactttcgcgtatcttcttttgttttgattattaaattgtttaattataacacgttaagtatcgctaagttggcttgcctagctccgacagtagggtccatcacgactcccgatggtgggaaatcttggtcgtgacaagttggtatcagagcactaggttacttgagtctcacagctcacggacaaactcggtagagtctgagggatcggtacggagacgtctgtattggttccccagaagctatagagttaggaaaaatttcactttgttcattcttgtcgtgcgattctgtttctcaatattgattgtctttctactctattccttcgcagatggcgagaactcgtgcttcctcttcttctgatcagcagcccgaggccccaacagcaactccagctaggggcagagggtgaggccgcgctagaggccgtggtaggggcagagctcagccccgagcagcagcactagtggcggggccttaggttgatgttgaggaggttccagccccagctgtgcctatggtcattccgggtcttcaggaggccctagctcagattatgtcggcttgctctggcctagcccaggtggtctcagccaccgccgcagcagccacttcacagacagggggaggcaatcagacccccattgctcgcacacctgagccagtagcgccgggatttcagactccagaggcaccgccagtgcagcaggttgccccagttcagcccgaggtgccagttcctccagttgtgccggttcagtcagctgtgccagttctgtcaattgtgccagctcagcctatagaagcagcccaaccagttgttgcgggccagtctagtgatggtgcgactatgtccgcggattctttgtggagacttgaccgttttaccagactcttcactcatactttcagtggtacgccttcagaggatgctcagaactttctgttcagctgtcatgaggtcttgaggactatgggtattctagagaccaatggggtcgattttgctacttttcaccgggccggatccgccaagacttggtggagggatttctgtctatctagaccagcagggtctccaactttgacttgggatcagtttgcgaagttgtttctggggaagtttctccccgttactcagagggatgctcttcgtcgtcagtttgagcgtcttcagcagggatcgatgactgttactcagtatgagacgtgatttttggatcttgcccgtcatgccatattgatacttcccactgagggcgagagagttaggagatttgtggatgggttgactccggagatccgagtgcagatggctacgagtgccggtagtgatctctcgtttcaggacgcggcggatggtgctcgccggattgagatggcactatctttgggaggtggtttcgggtcagataagaggccccgtcattctggtcgattcaatggtaactcgtctggaggtagaggttcatacggtaggggccagcccccgaggccttatcagtcagctctccaggcctctcatggtgctccaggtagcagcagttctcagcagtattattctggtcagcagcctattagtgccccgccactctagagcttccggggaggacattcaggccgacaggttcagcagccccagcagccaagggtttgtcatggttgtggcgatccaggccacattatcagattttgtccctatgcttcgagtagatctcagcaacagggaccccgttccatgattcaggcaccacctaccccacagtctgcccagccaactagaggcgggggtagggtcatagaggtggaggcagaggtcttagaggtggagctcagccagctagaggtagaggtcagacagaagtagatcagcctagaggtgctattcagggaggtggggcccagccccgttgttatgctttgccagccaggccaaaggctgagtcttcggatgcagtgatcacaggtactattctggtttgtgatagagatgcttcagtattatttgatcctggctccacgtattcctatgtgtgagcacgtgatttttgctctcacgacaattactcccaaaaatttcaaaataaaataatttttgtttgtttgcaattgttgggaattttcgtatattgtttccatttatccgtgcgtgtttacttgttaaaattaattgaaaaatacaaaaaatatgtgtcacatgcattaggaattaatcgtacatttccggaattaatcaaccgtaatttgatcgaaaggaaattatgaaggtgtgcaattttattccttgatattgtgtgattttatttgagtgtgcgatttgtgttattttatttgttaagtgtgtaattagtttaatttatcttttaattaataggtgtaattgtacaaaaatttgtttaagtattttagatttaaatgtgcctgtaattgaaaagggggctaagcttgccaagttgaaaagaaaacaaaagaggctaaatttgtaaggaaaacatgcccaaattgcaagcctgatccggtccaagaccacctcaccaggcacgccaagaaacggcgccgttttggtaacggctaatctcagccgttcagatcataggatccaacggtccctgatgccacccgttacccgacccatgtgaaacccggtccgacccgtcccctaactaaaccaaacgaccacgttttgaggggagggaatgatcagggccgttgatcacacttgatccaacggcccagatcaatcgatacaagtttaatataccaacacaccctaacccgcctcattctcatcagacaccccccctatcatttctctcatcttctctcaaagggttatgaaccctagccgccgcctcagttcacttccccattaaacccggcggcaacgccgccggtgacctcaccccttacctatttgtgaccatctggtcatcccccatccaatgataccattttttggccatttcaagaaggtttctgaaaaccctagaaatcatctagggttccgttgtgtgaagaacggttctgggtctagaggggtattctcacaagtgttcgtagccaagaaaacactccgattatgaggtcattttgtgagctgttgagtccgagttttgacaggcccgaaaagctaagtcctcttcttctttgtttttattttagttatatgtgtatgtgtagtatctgtatttcatatgatttgatttcactatgtttgtctcttttaatttttctgattcatctcctaaggaccttttctttggtccgttccttcttttagtgttggtaaatagttcattgattgtctgagtgttttgacagtattagattagttttgttcgtatttagttcttgttgttttgactgttaagacctctgaatgccagattcggactatactctattttagttggttgttgaactacttaatagttcgtataatcagttaaataagagtcgtctagaagctaagcctttatgagttccttatctgtgacttaatgccactggtttatcttgttcatttttatatcgatctcctatttttcagtcgattttattctgttcgttgattattgtatctgtcataagctacgtttagtgtgtttgatgtcgtcgaataattagtttcgtaggtttactgtttttcccaaagccttgaattaccttgcttatatgatgattattggttatcgattgcatatgttctaatatatagtcgattagttaagcttcgtcgattaggtcgttcgtatatatttgaaccatttagcatttttgtttggtctggtgtcaatatacttcgacattttgttgatatagtcgttcaaaacatgattgacattcagattgtttgtgattttcaatttttagtttgtcttgattaattaaaatttctggtaaatgtcaatgaatcttaattcagttttggtttcaccttcaaatgttctgttgaatccctttgttgttggtgtgattttgtttgaaatcagttgatttgtttcaataaggaatcagttcggttaagttatcagatttaggagattggatatagctgtagaaacaataagcttaagcctgaaaatcagttttaactccaggtttatatagataagtaatttcagactccaaaaccttaggttaatgagcagttaattcctaagggggtaatctagggggctgctaacaactagggggtaatatagggggtgctactttgggtaggtagggggtaatatagggggtgctactttgggtaggaggcagtttagttttttaataatagcactagcttagtggaagtttttaaaaataaaaagagaataggaaaggcattaatggactgcctatttaaaaggggggaatcagattgattaaagaggagaacattgaaaaagaatctgaaaaacagagagtaaaagagaaggaagaaaaaagagaagaacattgaaaagttcagagaaaatagagagttgaaagagagaatcagtgagaaaaagggagaaaaagattctgaaagttcaatccttttgagagtttaaggagtaaggctagagtttaacaccatagttttgtttaaggctagagtttaacaccatagttttgtattgcctaggttctcatttgatttggatttcttctgggcttattatttgtttgctggagtctgtgatattggatagcaaagttcctacttggttttttttcatcttctattcctgggcctattttgttgctgtgggatagttactgttattgctgtgactgttgttgatctgctactgctacttatttgtaactgatactacttctctcctttgtttaaaaatccaggtacacaatcgagactcaagttgatgtaattttgaggttcaagcatgaaataaattggatccatgttgcgatttactctcctgttgattcctatttttattctagatgaattttgttatgatagcttattagttgtagtgaataaagtgcattctagggctataaacctatttgttattttgaacatggctagtgtcagtgtaatattgaattcccagtaactagactcaacatgcttgttagaagtttttgagttaagtaaactgtagctttgtggtttaatatgcaggaagtataaaatgtttgtggcttacgaatgctggaatgtaaagggtgtatgattgaagtaattgaatgagttcaattttaatacggtattttagttctttagttggtcagattggatgttaagcagttaaatcatttgggataaaactttgagtctgtctctaatgtgaaatccgatttagctctatctagtaatagtctgtccacagtttgaagttgattttagttcaataaaatttggtaattatactcttgcatgaagtggttttgtttaaatagccgaagtttttgaattcaattggtcaggaattagtggcccaatgtacatctctgaattgtcgaatgcatttaaactgcaattcatctcctgttagtttaattaatggtgaatctcttttgtttgtttaaactaattggaatgtggaagtcatttgtgttacttcaaagggcttaaagcctgcgcgtagctcttgacccctgaactgtgcacatgtcgagcccaaagtgcgactgatttgttaggcaggcccatttggcctttttccattacgcatttgtgtagtgaaggttattgggccatatccaagcccaaaaggaatttgatagtacatagaccaattgaagtgttttctttaacaataaatttggaattcgggttttgagttaggtagcgggtcctaaactaaaaggtttatccttttgtttggatccggacttgaacctaaggcccggattttaaacatgtaattaattaggatttttctcttttagagacaaattaattagaaaatgtagtcactctaggcttatcctttaaaaataaaaggaggcgtgcctcgccaaataaattgcaaattgtggggccctcagtaaattttattaataatatacttagaattcgggatgggtcgtctagtaaatttcacggccttccccaaaataataacgcgttagactctttaggcgcgtatttaataatgctatcttccctaaactcgggtgagcatttcatgcggcccaaatccaaatcctaatgcccggtagcgggtgagcgttgtaagattcggaattcgggttttgagttaggtagcgggtcttaaactaaaaggttcatccttttgtttggatccggacttgaatttaatgcctgatttctaaattttaaacgacgttcaattttcaaataaattcaataaaagcggttaaaggtaaaattggcacataggcatttgatgtataaaaaatcagattttagttattcatggcaatttaagcgaccgtgctagaaccacgggctccgagggtgcctaataccttccctcaagtcaacagaattccttattcagaatttctggttcgtagactccaactggaagtcgaaattttcctcggttcgggattcaagaaaaaccggtgacttgggacaccaaaaacccaacctttcccaagtggcgactctgaaataaataatcccattccgattgtcacttaaaatgaaaaaactccttacgcctttgcgggtgtaatgaaaaggaggtgtgacactatgtgtcgtcgtattttgcaacttatttggtaatgcctagtgaggctttgggtattcctgttcatgtatccactccagtgagggattctatagtagtggatcgggttcatcgctcgtgtgttgtggtgttcaggggtcttgagaaccgtgtcgacttgttattgttggatatggtggatttcgacgtcattctagggatggattggttgtctccttatcatgcgatcttggattgtcatgccaagaccgtgaccttggcgttgccggatatgccccgattagagtggagagggacccccggtcacaccactcgcaacattatttcttatgtgaaggctcgacgcatggtcgagaaggggtgtctagcttacctggcttatgtccgcgactccagcgctgaggtcccgtctatcgattccgttcctattgttcgagagttccctgaggttttcccttcagatttgccgggaatgccgcccgacagggacatcgatttctgtattgatttggcgccgggcacccagcccatctctaccccgccttatcgcatggtgccgccagagttgaaagagttaaaagaccagcttcaggatttgcttgagaagggtttcattagacccagtgtttcgccttggggcgctccagtattgtttgtaaggaagaaggatggttccatgagaatgtgcattgattaccggcagttgaacaaggtaacgattaagaacaaatatcccctgccaaggatcgacgatttatttgatcagcttcagggttcgaaagtattgtcaaagatagatttgagatctggttatcatcagctaaggattagggcgtctgatgtccctaagacagcttttcgtactcggtatgggcactacgagtttttggtcatgtcgtttggattgactaatgccccagcagcattcatggagttgatgaatagagtattcaggccatatctggatttgtttgtgatcgtcttcattgactacattcttatctactcccgcagtctggaagagcatgagcaacacctcagagtggttctacagactctgaaggatagtcaattgtatgctaagttctcgaagtgtgagttttggttgagttcgatcgtattcttgggtcatgtcgtgtcagcagcaggtattcaggtggacccgaagaagagagaggcagtcaagaactggcctcgaccagcttcagctacagagattcgaagctttttggggttagctggttattacagacggttcgtagaggggttttcatccatagcatcccctatgaccagattgacccagaagggtgccttattcaggtggtcggacgagtgtgaggcgagctttcagaagctcaagacggcattgaccacgacaccggtattagtgctgcctacaggttcaggaccatacacggtctattgtgatgctttccgtatcgggcttggtacagtattgatgaaggatggtaaagttatagcctacgcttcgaggcagttgaagatccacgagaagaattatccagttcacgaccttgagttggcagctattgttcatgccttaaagatttggaggcattacttatatggggtgacgtgtgaggtttacaccgatcacaagagtcttcagtatttgttcaagcagaaggagttaaatatgaggcagagaagatggttagagttgttgaaagattatgatgttactattctatatcatctgtggaaggccaatgtggtggccgatgcattgaataggaagtctgccagcatgggtagtcttgcctatattccagttggtcagagatcgcttgccttggatgttcaggccttggccaatcgttttgttaggttggatgtttccgagcccaacagagttttggcttgcacggttgccctctcttctctatttgagcgtattcgtgagcttcagtttcatgatccccatttatgtgtcctgagatacacggttcagcgaggaggttccaagaaagtgactttgggaagtgatggtgtgttgagatttcaggggcgagtttgtgtacccaatgttgatggtattcgtgatttgatcttagcggaggcccacagttctcggtattctattcacccgggcgccacgaagatatatcaggatttgaaacagcattattggtggcgtagaatgaagaaggatatagtagcttatgtcgctcggtgtttgaattgtcagcaggtcaagtatgagcattagagacccggtggtctatttcagaggattgagcttcccgagtggaagtgggagaggattaccatggattttgttaccggtcttccgatgactcggaggcagtgtgattcagtttgggttattgtggataggctgactaagtcagcgcacttcattccggttgctaccacctattcatcccagagattagccgagatttatatcagagagatcgtccgccttcatggggtgcccatatctatcattccggatcgaggttcgcagtttacttcgcgtttctggaaagccttgcagggagagttgggcactcaggttcagatgagcacaacatttcatccccagacggacggtcagtccgagaagacgattcagattcttgaggatatgcttcgagcctgtgtcattgactttggaggctcgtgggaccggtttttgccattaacagagtttgcctacaacaatagctaccagtccagcattcagatggctccatatgaggcgttgtatggtaggcggtgtaggtccccagtcggatggttcgagccgggaaaggctcgattattgggtacggatatggttcaggaggccttagataaggtcaagatcattcaggataggctccgtacagctcagtctagacagaagagttatgcagaccgcaaggtcagggatgttgccttcatgattggtgagcgagtattgctccgtgtgtcgcctatgaaaggcgtgatgaggtttaggaagaagggcaagctcagccctaggttcatcggtccgattcgagattttggagcgagtgggagaggtggcctatagacttgctttgccgcccagtttatcagctgtgcatccagtgttccatgtatccatgctccggaagtatcacggcgatccattgcatgtgttagattttagcactgtccaattggacaaggatctgtcatatgaggaggagccggtggctattctagaccggcaggttcgacagttgaggtcgaagagttttccttcggtgcgtgttcagtggagaggtcagcctcctgaggcttcgacctgggagtccgagtccgatatgcgtagccgttatccccatatgtttcccgactcaggtatttctttcttttgtccgttcgaggacgaacggttgttttagaggtggagattgtgacgacccaaagggtcatcaccataattctcccttgctctgtgcttctgaggccttgaaaacctcttgagcggttgcctcaatttgcgtgcgcagtccaggcgcgaagccggaaaagctttgatgataagaaatttgaattgtatgtttaaaatgataaatttcaagtataatactgatatggttgacttcggtcaatattttgggcaaacggacccggacccgtgatttaatggtctcggaaaatccgtaggaaaatatgggactcgggcgtattcccggaatcgaaatccgaggtcccaagcccgaggaaataatttttcagtttaattgattgctgttaatgttaaaggaaaatgaatttgaaaaatgaccaaaaggtaatggtatcaggctcatattttggttccgacgcccggtacaagtcatatataatggttaagtgttgtttgtgaagtttcatgtgaaccggacgtcgtttgacgtgtttcggacttgaatatagaaatcttgagtttcatgtgttaaagagtgaaattgtgattttggggcttaatccattgattatgatgttattttggcgatttgatcgcacgagtaagtccgtagggtattttagaggtagtgtacatgtgtggtttggagcccgagggctcgggagtgttttggctagatgtcggatgcattttggcatggttggaattgcagcaggtgcctcggacctacaggcttcgcatttgcgaaggggtccaattccagccaatcacgcaaatgcgagtttgacttcgcaaatgcgaagtttcccattttcctccagatatcgcaaatgcgagtttgacttcgcaaatgcgaagtcccccaatttccctcctatctcgcaaatgcgatgtcccctttccccaaccccaattcgcaaatgcgaaattaatgtcgcaaatgcgactttccccttttcttcagccacttcgcaattgcgaagtttttctcgcaattgcgagatttacatttcttcagcccacttcgcatttgcgaattgtttctcgcaaatgcgagattccccctttggccagccatttcgcaattgcgaacttaatctcgcaattgcgaagtccgcacctgtgtaaaaattacttaaacgatttttgaagctcatttccattatttcaaaacccaaaaccctcttggcgattttctctcatctctttcttctccaaatcgattgtaagtccatttttacttgttttcttcaatcatcatcatcatctaacatgattttatcttaaatcaaagcttttcatgggttaaaaatggagatttgggtagaaactagggttttcatattttgagcttttggacctcgatttgaggtccgatttcaattctaattatagatatgagctcatgagggaatgggtaacccggttttggtccgaacctcgagtttcgaccacgtaggcccgggggcgttttgggaatttttgggtaaaactttgggaaactcattcttatgcatttaaattagtttaattagcatttgttaattcgtttgggtaatttatgattagatatcgttgtttgggagtcagattctagaggaaaggcggtgttagaggcttgattgctagtttcggcattgaggtaagtgtttgatctaaccttggtttgagggaataggattagggtattgcttgctatgtgctacttggtgtcggtgtataggcatggtgatggttatctatgcacccgagtctagcatgaccgtgagtccttacttgttctaattgaattatacctcccgaattcttggattgataagcatgattagtaaggtgtacagtcgagaataagtaataatttgtgtagtttgggagctttggctcgacttggctttgactgattgatgaagtataaaatggatgtagatgtgatcatatccctcgccgggatctttaatggcatttatattctttccccgttacgaattgatcgagttctcatgatttagcgagggagagtgtttatgcacgacgggtccttccgtgccatgatattgaaatgtttatgcacgacgggtctttccgtgccatgttattgaaatgattaagcacgacgggtcttaccgtgccatgatatgagagtgtgggaggatgagaagcacgatgggtgttgccgtgtattgtttgattattgttgtactgtttgaaagtaaaggcaactgttttgtatcgtaaacgacatccctgacttctctgcttaacttgtagttccgtattacgttcttcctgattagttttgcctgttgaactgtttttccccttatcatgtcccctcccgttaagctatttaagttcctattttaattactgctagtatgtatagaactgtattattgcacaggttgatttgaaagtaggtcctgtctagcctcgtcactacctcgtgagccggggttaggccaggcacttaccagcacatggggtcggttgtgctgatgctactcttgctgtgcctttttgtgcatagatccgggagcggcctttacccagcagcagtagcagtagtctgggagcgcgccttcattccagagactaccaggtagcttactggcgttcgtgggcccggagtctcctcttacattagttatttggtcctttgtatcggacgagtactaaacattgtatttcttctttcaatccaatggttgtagtaactctttagacagtgcgtgagcattgtgacactacttttttgggtagaagtttgtagacagttttccgttctgtatttcgctttatctcagtattatattatgacttccgcgtatcttcttttgttttgattattaaattgtttaattataacacgttaagtatcgctaagttggcttgcctagctccaacagtaggcaccatcacgactcccgatggtgggaaatccgggtcgtgacattatttacctaatatattaaattataggggaaaaatgaacataaaccaatacaataacgaaatatgcttcaacaaatgatttgactataatagcaaaaaaagtgtcatgtcttccaaatagttgaaagatcaaaatgtcggtctaaccctaaagctgaaaatgaattgccactcctaccaaatgccttcaccaaattagcattgactttacggttagtatatagtagtggtgacaaaatgaggaaaaaacaataaggcgaaatgatctcctggccacccaaacttgcgcccgttttgaaagccgatacatgaacttccaactttcccatttggacacttaaactactgaatcacaaaactaataaacacatttgaccattgacccatcctatgtggcgtcagttggtcctagtcagccccatgcgtgaacttcacgaatttccaacgcgtgagggaagcccttcccatgcccaacggtcaaaaatatgcctatttaagtggggtcttatccttttcaattggaaacatttaatccctctattatatccccttctcatttcgctgctttctttcttaatagctgaagccttaattttttttttaatttaattttccagtttgtattaatgaatcaaagatctgtaatttgtcattgtggagttgaagctcatatttgcatcacttggaagccaacaaatccaggaaggaggttttatgggtgctcaaactatggtcgagccaattcttgtaatttttttaggtggtttgacccacctcttccagatcactataaacaagtgatttcagggctgctagcaagaattaaagagagagatcgattacagagaaggaagagggtgaagttcattgtaacagtagttgttgtagtagcactaacaattgtaattttcttcttagtgtagttagcattaccatcataaccctattatgtacaatgatagtggctgaatgactaatgtatttttttgtggaatgaaaatcacattataacataaacaaccacacatatataaacaaccaagaatagccttgttggttgacaaaataagcactgaactgctgtgtagtagcagtaatacgtaaagcattgttccaaaagagaagtcaagagttaaaaagacttaagttaactacaaatttagttctgcaactaacagactaaagttaccacaaaaacaaacattcatttagcttcaaggctgagattagttgaggttttgatgagatggagtttggcttggctgagatgaagaatggacttgaggttggcttaggcttgcttcagtttgtcttctcctcaactgttgttgaagttgcctttgagttttagcatttcttccttgccaccttagttcaggtgcactgtatccgagatctatattggtctgcccaacatccacaacttttgaaggagcagaatataccctatctcttcctccacactacataggaacacaaattagtacccaaacaactaatatataaaaaaaattcaaatcactaatgatcttacgctttctatcactgttccagaatcactaaacaatataccaaatccagtagttcttggtctttctcttagtccactacctcttggccttcctctaacactagctataatattctcagaagttcttgatctcatacttccagtatcctgatgtaagataaattagcttctagtacagaataactaaaatatagattaactaaaataaatactcacagatgcacttgcaacagcagcctgtgatggttgagtatttgtggccctggcagttgcagaatcacttgtaggacctgattgttgagttgttgtttcagcagcctgtgatggttgagtagcaccagaattactggttcctgctgttccagatgtttgtcctctctgaaattttcaaaatataaaataagatatacaaataaaaactgaatacacaatcaaacacaaattgaagacacaaactgaatacattaccaggataggacaccccttcttgttatggcctactgtcttacaattagagcatgtcattggtgtccctttccttgatctcttaccaaactttttcttaggttcatcagtagcctttttcctatttttctttggtctaccaggcatcttggtaatcacaggagggtcaactgttggattttctgttgatggccacatctccatgttggttactggttgtatgtaacaactaaaagccttcagatatgtttctttcttgtaccagtggcttacatagttagcagactcatatttattaaaaaacattgcacatattgcatgggagcatggtagtcttttgagctgccatgatctacatgtgcatgtatagttggagatgtcaacaatatgtttgtacaccccatgttgtatctcatacccagtatccccattacaccttagttcatgcttaacagcatattgagattgttcttctatgtaccccattgccataggagatacatcagaaatccaccttgttgcaaattctctcattccagtcatcctctccatcaccttcactctaatctcttctaacatggttaggatagacttgtgcctagctgataagatccaactgttaaaggtctcacacatgttgttctccacaacatcacacttactccaatctttgaagaatgctctacaccaagcctgttttgggtatttcagcaagtcctcaactatcttactatcacctaattcagccaactcatctaacttagccttcaaatatgcttcaaatgaagcccttgcacaggcccaaaatttcttccttctttcctctcctttccatttttgtttccagttgctccatatgtgtcttgtacacattctatgttcagcatttggtaacaactcagaaacagatgcaacaagtcccttaaacaacaaaaagaaaacaattagaatagcaaaaaaatatataaagtaaccaagacattaaaggaagaacaaatgtgtataccttctgcatatcagaaatgatagtcagcccctccccttcagattcaagaagctgtagatcatgcatcaagcacctaaagaaccatgaccaagtgtgctttgtctccttttccacaactacccaagtaacagggtacatttggttgttaccatctttggcaatgcatgataacaactcacccttacacacacccttcagaaatgccccatcaaagccaataacatttctacacccttccaaccaaccaactttgcaagcatgtagacaaacatagatacccacaaacacctccttaccaggtatggtctccttggaggtcttcacaacaatagtgctgccaggatttgtagagcttaacacattagcataatcataaattctagcaaactctttcttgtaatcaccaagatactaacccataacctgatgtttagccctagcacatatgaattttccaacataaacaccatactttatcctaatcaaatcctgcaacttcttaagtttaatgtcaggttggttgataatcttgtccttgtaatgtttagcaacccatgctgtgttatccatcttgtttctggttgctctaaaacaatcatgaacaagatggtagctcttaacaatgaaattccttgtgtgtccctccaaactgcccaaaacatgccatctacatcttgttgagttaagacatttagccctaaacctatgttgctcattaggcctcaacttaatttgacatcttctctgtacagcatagtcttgcaaagcagttctgaactgtttcacattttcaaacaccatttccaactggaaacaaattttcttacaagcaggatcaaaatagaacctactgctgtaccttcttggttgagggttatgcaccccatctttttcttcatcaatatcctcactacctggatctgaactgtccagatattgctcatcccctcccaactttccagcatatttgctcccattgtctttgtacatatcttcaaaaccagggtctatacctacaggtccagtaggtatctcatcattattaactttagaagaccttaatttactactctttgcattcactttagcctgcgtagaagcaacaacttcaggttctaggtcactagtctcaccagcaatatcctcatcacaaccatataaggactcatctgtatcatcatcatcatcttcaaaattagcctcatactctttatcactctcactactcaactcatcaccctcatcaacaccctggacatcaccctcaacatcaccctcagaatcagttgctatatgaaagttatagaagtcatcttcatcttcactaaaatcttcagttgcagaagaggtttcagtagaagaactgactgcagccctctttttacccttcccattagtgttatcacccctatttatatcactgttaggtgagtgtgttgccctagcattaaaatcagttggctgcccatgtggcatttcattaacagcaggctgaacatcagtggggtccatatttaaaccaccactacttaacatttcatctagttccacatcaacacatggtgtattaattatgtgacatatatagacatcaataaaatccacatccttaaggtcttgacacaaagctaacacatcagcatcatatttcaaatatctaaatgctccctttcggttcactttacatgcatatttatccactgttaagtaccccatatccttagtccaatcatgaaattgaattatatgcaattcatcaatgtcagcttgaagtacaactggccaagtttgaccatttacatacctcgcaattgggtcagccactaaacaccctaagtgatgaaactgtaatttcacataaatggccattgaaacctatataaaaaagggggacaagtcagatacactttaaccctaaaaagcaataaagtttaacaaaatgggagacaagaatatttggatatacaaaaaagccctaagtttttattcactaactgccatatcactcatgaaaaaagacaaagccctaaaataaagtgaagattccataatttgtgcgtgcagataaaagccctaattttttaaccccaaatgccagatcagtgatgaaaacgacaaaacaattgaagattcgagtgttttcccaaatataaaaaccctaatacaaattccctaatatcagatgaagaaataagcatgcatcaatagatatccttcactaacaaacaacattaacattacccacattatttttaacgaaaatagaagaagaagatgaaatcgacatcaaaattaaccaactaaccttcagatataaacttcacagcagccaatatttccaacaaaagtcgaacagcttctaattaaaggaggagggaccaaaatcgtatgcttttggagtgattaatggaggggaccaggtatttcgaccatcgtgtaagagaggtagggtttggttagatagagagagaaaaaaatgaaaagtgggggaagggtttgtcggtctttgagttaaagacggggaccccaaaacagttggctcttatttcctgccctttgacgtgtatcgatattattggtcatttgtggactaggttgacacgttggcgaatgtgtaatacacacgcgtatggtcaaagagaaaatgtgtttattagttttgtgattcagtagtttaagcgtccaaatggaaaagttggaagttcatgtatcggctttaaaaacgggcgcaagtttgagtggccaggaagccattttgaataaaaagcttttaaaatatgggtcaaatatgaataagatccatattatccacttaaaaatggttaattaatgagtttaacttttatatttgcaaatacgcaaattgaagattattcaagtttgaaaaactagaaattctcccgagagtgaacatattcaagaagccatatataacatggatattcaccagttaactcattttctatctctatgtatgctctaccctctccagaccccaccgttatttcatgatatcatgcatcaacaatgtgaaaaataaacttgcaacataattaagaaaaaataggatacataatagaattattatataaaaaagtagggtaaatgataaaatgtgattattttataataaggaagggcaagatgagagaaaaaaaacaagtaaacaacgtcactacaccaaatttgccgttccataaagtgacatttttcatcgttaagaaatgattgatttaacgatacgatacaataaaatttactataagtaatacaaaaattgtgttaaagtagtaatacgatacaatacaatatgtaacgccatccaaacacgctgttagggcatcaagttgtttagtgcctttgaaattaatttcagatcacaaatccctgaccggcttgcgaatttcttgtcatatatatgatcatttgagttatgtgtgcaaaatttcttgttaacagcttcttcaacatattttatcatgttattcgtttctactaactcttacatgtcttgttgtttgatggcaaaatatgtaaagcagtaaataaaatctagtattagacttatatctatctgcagccggatggatgattcctcttgtttgactcaaaagttatttaatactttttaagcaaatcaatcaaaagagatgaaggggtaaatcatagtcaatcctaattcacaatggatcgaaaaatagacttgatacttggaaaataatgaagcaataacatttgaggagttttattgattatagaaacatgccttgcctccccttggagaggttcagggaattacaatcatgttttccctcaaagtatcgatttttccttgcccgtaggttcaaggttctcttcatggagttctgctttccctttctgggatatttgagtgatggagaagaaggctggggctggagcctcttttttgtgctttcttcccttgtatttatagtcaaaagagggagatctcctgagctcgccacaattttcatggccaggtgggggagatatcatctcatcgtggataggtattggctgcgtcgcttgttttggaaatagtaataacgagtcggagttgagttcgacgactaccctcgtgaaccgattaggacggggtcatcgccgtcgtggtcgtatggttagattttagactaatacagttattcccttcgtccgtcggggtcgtgccttgctgacctcgatgggccgatcatatgtgtgacgtggtcgggaggagttagattcgccctttattccttggttgcattataaattttgaaacacccgggggcgtctttctggtattcgtgtaccgtcacgtcgatttcaaagctgaagcgccggttggtaaacaaaacgtcgcttcgtgcagacagtaataatggcccacgtttccggtaagttgaactatttcacgcctggtcaggttctaatggcgactgttgggtttcgtgcttgaggaatttatgtcttataaattgaagggatctgtcaaatgctgttcacatttcatcgctcccttttgagagaatttccaggatatcttcctttctgctaacttgagctttcctttcctttcttacctgataccttctgattttcttacttcccccacaaagttccttttcttcttgttcttgggttgaaaatggaaggaacttcctcctatgataaccttccggctacccctccggcaactgagaaccttgctccagtagccggagataccgaactgatggagagcaaagatgttccttcggtagatgagattttatcccgcccatgaagggccgtgatagatttcagcgccgatggcggcgaggagcagatggatattctgtcgggatagtggatttacgggaacggtggggcattcccaactatgttgagatggtactagcaggcaggaacgacagggtccaaatcgaccgccccgaattatgcatgttctacgcttgcccctttctcgtgggatacaggctcccacttcccatattggtggtcgacttctgccgctattacgaggtgtgtcttgcccaactctccccttatctatacaaattgttcctcatgtttatcaagtaagcggagttggccggtcgtgaggtcactctgagacacgtgcttagtttgttcgctcctcaaaatattcgcggcactatgatccatgcgcgtccccgagggtcaagatggacgacagaaacaatcatcgctttgttgataactttttctatgtgcgtgtgacgacccaaagggtcatcaccaaaattctttcttttttcgtgcttccgaggccttgaaaacctcacttttagttgcctcgatttgcgtatgcagatcgggcgcatagccggaaagtttttatgttgaaatatatgaattatgtgaaaaatttgaagaattttgatattaatatgaataaacttgactttggtaaatgaacccggacccataatttgatggtctcggaaggttcttagaaaaatatgggacttgggcgtatgcccggaattgaattccgaggtcccaggcctgagaaatgaatttttccgtgaaattattttctgaaaaatgtttaaggaaaataaaaataaaatttgatcaaaaagtaatggtatcgggctcatattttggttccgactcccggtacaggccatatatattggttaagctcttcctgttaagtttggttgaaaccggacgtcgtttgacgtgtttcggccttaaattggaaattttggatgtttatgaaatttgaaagttttcttggattttaagcctcaattaattgtttttgatgttattttggcgatttgatcgctcgagcaagttcgtatgatatttttgagtcagtgtacatatttgatttggagccccgagggctcgggtgagtttctgataggtgtcagagtgtttttggccttaggaaatgcagaagaattgctactgcattctgtccagacattccttctatgcgatcgcatggtcaggcttgcgatcgcatagaccggtatggcccttctatgcgatcgcagcttctcctttgcagttgcagtgaccaaagttcctttactctatgcgatcgcatcccttcccccgcgattgcatagagcaatttcgcccagcgattttaaagacccaaaaatagaacagaaatgggataaaaatcccatttctcaaactctctcttctccaacagctcttgggcgatttttggagcgattcttcgttaaactttcttgggtaagtgttgctcaacttgttttcttctactttcattaatattattcgaattcttaggcctaaacatgtgaaaataggtagaaaattagagaattaggtagagttagggttttcaaagaattggtgatttaacctcgttatggggtcgaacttgggaacaaattatatattcgggctcgtgagtgaatgggttatcggaatttggttcgaacctcgtattttgaccacgcgggcccagggtcgatttttacatttttgggcagaatgttttagaaaatatatttatccatttggattagtttgttaagtattattgatgatattaaatcaatcgtgtacagatacgattgaattggagccaaatttgaaaggaaaggcaatgcctaaggattgagttggccgtaaacctttgaggtaagtgtttgatctatcctagcttgagggaataggagttgagtatatttgctatttgttatgtgtggaatctgacgtataggcatgatgacgagtatctatacgtgggggtcgagcatgaccgtgggtcttaaattgataatttcacattcttatttgattctatgaaagaattatttgttgagccttggcactgagttatggtttttctcttgctaataatatattgtgaactatgttaaaagtgaaatgagaacgggtggtacgcctaccacaagatatgtattgaaatggaagcgagtggtacgcctaccacaatttatattgaaatgggagcgagtggtacgcctaccacaacttatattgattattgttattggccttagttgccggtgacatattgtgcattgtgataaagatgaaatgggagcgagtgttacgcctaccacaatttatattgaaataggagcgaatggtacgtctaccacaatttataattattattgttattggccttagttgccggtgacatattgtgcactgtgttgataatgaaatgggagcgagtggtacgactaccatatattatattgaaatgggagcgagtggtatgcctaccacagattatattgaaatgggagcgagtggtacgcctaccacaagttatattgaaataggagcgagtggtacgcctaccacaagatattaaatgaaatagggatcgggttgcacgccgcaacagatgagttgaacttaaaagtgaattaaattcctttattctatttctgccattatatattgttgctaccccagagcatgttttccttcccaaatattaaatgttgcttcctgttatttttgttgtatatatattttgaactgtacaggtttatgtgagtgtctggttctagccttgtcactacatcactgggataggccaaacacttaccagcacatagggtcggttgtgctaattctacactctgcgctcttttgtgcagatacatgtttcggacagcagcatcaacagtagtgtgggtattatctttccgctcagcgagacaccgaggtagctgtgagcacgtgatttttgctttacggaaattactccaaaagaaatcaaaaattaaaaggctaagtcgccttcgggtgcaattttgagagcttacggacaatttttggtaattgtgtggtccgtaaatgcccactattgatgtgattaaatgaagatataggttgcatgcattagaggttgatcgtacgctttcggaattgattgatcacaagttgatcgaaaggaaattgcgaaagtatgcgattccggttaattttggctaaaaaatgcgatttgtgttattctttatttaattgtgtaattttggtattaattttaaatgtttaattgtgtgttagtgtgtaatttactttaatttagttgtgtttaaaattgtatagtgtgtgcaagccaatgtggctatgtgtgtaagaagaggctaagtttaattaggatttaaaaagaaggaaggtggctagattttaaatgaaaacaggcccagttgagcagccctgaccctcacccgtccaaacccgaccctttccctgacccgtctgcccgttacactccaaacgaccccgtttttgatcccccgttttgatctcagccgttggattaaaatccaacggttgaggttaatatctcaatcttattaccctaaactacccaaacccccctgagataccccatttccccaaacacccctctatctcttcttctctctaaaccaaacgcnnnnnnnnnngacttgttgtttctgttgttattagtgagggtagttgtgaactacataatcgattcgattaacatcgtcgaatagtttgtttcgtatttccgttgtttgttcgactgccatgatccactgtttcttgtcgattaattgttatcgatttcgtatgtcgtagtcgattaattaagtgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaaaacacttagtctgaataataattgtgaactcaaaagggctgtaacaataacattggatcagacccttaggcaaataggattggcccaggtccaagttacacggacctgggcccaattgaaactgtccaggccaaaaagtgacggcccagacccaaaaatggcaacggacggcccctccccttcttcccttcaaatagcatcaatgaatgtaaataattagaataagccataacaacgagatgcatgtaaataaagttagaatttttattccgttttagagacacgttcgatatagaaaacgtagtcaactttaggatatcctttaaatttcgggctttctttaaaggtgtatatattacaagcataaatagattccgggatgagccgtttagccaatttcacggctttcccaacataataaaacgctagccttctctaggacgcgtcttaattaatttacctccctaaattcgggtttgcatttatgcaacccagatccaaatctcaacgaagtcgaggtatgtcaataaacacggttacaccgggtgtggcgttgtttaggggcatgttttcacaacgttgcaagtcttttaaaagattacaacaataaaagcggttttaatgttaaaaggcacatcagttatagcatgtattaaaatcagatatttggcaaatgcgacaatttaagcgaccgtgctagaaccacgggattcgagggtgcctaataccttccctcgggtcaacagaattccttacttagaatctctggttcgcagacttcaattggaaagtcgaatattttcctcgaattgggattaaaataaaccggtgacttgggacaccaaaagccaaacctttcccaagtggcgactctgaaatcaattaaataatcccatttcgaatattgtcacttaaattggaaaaactcccttgcgcatttatccctcggggtgtgtgcgcgccaaaaggaggtgtgacagctctggcgactctggtggggattagaacccagaacattttgttcagggttcagaattcgagcttagatgaattgttgtgttttgttatatctgattcttatacatgtttgtgctaatgtgctagttggctgttttaccgctttgatattgttgaactgtattataaattgtcttcttgcgcaccccttctgagtcttctgaatattatcccgggaatcgcggatacgcgccccatttctgtcaagataaagccggtgagcctgggctcccagtgaaggattgttaaacccgtttaagaacggggagggtccagtagctaaagccggaaaagcattgctcccggtatgctaccccttcccaactcgagttgtccgctcgttttatggccagtctagatgctcctcacacccaaggcagataaaacctagaatgacataacctcatgccggatccctagtaggacaacgtttatttgcatcacgttgcatttgacttagggggctcaacacaggggttgagtccgtctaggaatagcaacctgaaacaaaagaccatcctgctgcatcttgtttgagttgtgcattaaattgtcccgactggcatgctgaccggcttatgatgtgaggaaagagaaaaatgacagggtatagataactaccaaattttcaaaaaaccaagtagtgtcaaagtgctgtcaaaattttggaaaatgtttttaagtcagttttatttaggcgaactacgctggtttgattctcacaaggtgtgggatacgtaggcaaccctcatcgggttcaacctcccctttgcaaaaataacaaaaaatgtccaaaaaatgtatttgcgtcttgaataaatcgggtgatgccgttttgcaaaagtagccaaatgttcctaaacggaacgccggaaggccgactttgcgcaaacagccaccttgggtcgtattttgattttcgaccctcacagccttaaaaccttcgtcctcgaggcgatgaaaggtcgtgttttccataccgggtcatttgtgtttaaatttgaaaatatggaaaaagagtcgtaggaggcgagtgatgccgttttgcgaaaatagccgaatgttcccaagcgggacgccggaaggctgactttgcaaaaatggctattttggtcaatttggatttttggccggttagctaacgcagccttaaaatcttcgcccccgaggtgcttgaaaggccgtgtttgcaaaactaggccgtgtggtcaggtgaataccatttgatttttggtcaaaataaatcggtctagccccaaaattcatgaaaattgggaaggggccatgtttgcaaaaatagtcatttggttgaaattggcacgcagaggaagaaattgttaattttgtgtttattattatttaccttttattggcgaactacgcttggtctgattcgtgcggggtcacgatacgttggcaatctccataagattcgaccacaacgaaaaaaataaaagaaaaagaaaagagaaagaggccgaaaaaagcaccaaccacattgttcgaagcactaagccgggatgacgcatgcaaatcggggcaaacatgttagaaatggttgactgcctaggaacattgcatccctaaatgtgcaaatatgatgtatgttgaaactaacgctaacaaggttgttgtttttgccgcaatccagttagttgttaaaacgttctggcaccataccattaccagacaagatccaaagggcccgtacctgacaacatgaccggttcagagaacagtgccgaatcaaacagaacggcacaacagatgctgaaagaagcacttgagaaaatagagagaatggggctagaaatgagtcaaatgcagttagccctagccaaggtacaaaaagaacccgaatcatccgttgaccctcatcttccaccggggcatacgccagaataccctcaccacggcctttcagcaagtcagcactactttcaagaaaggagccactatgatacccaagctccaccccaaaatacgaaccttccactaccaagcacgccggtttttgcggcaccacctacattgcaaagaccgccgaatgagccactatttcaagctcatgacacacaatacttccctcatgaacccacagtcaaagcacctgaaccatacgcctataatccccactttgaggttccggcggagattgaaaggccggacaagagcatagagcaggacgaactggcacggaagttcaaaagcctggagcagtccttcaggagcaagcatggtttagataatcaagtcagtatggcatacaaggatctgtgcccttttcctaatgcccgactgcctgcagggttcaagatgccaaagtttgatctatacgaggggcatggcgatcctgtagcacatttacggggtttttgtaacacgatgagaggagcgggaggcaaagaagagctactgatagcttacttcagccagagtttgaagggggcagcgttggaatggtatacccgccaagatcccagcaagtggtacacctgggacgatctcacacaagctttcacagctcaattccactacaatcttgagatagtccctgaccgcctcacaatacagaaaaccagacagaagcccggggagagtttccgtgaattcggttttcgctggagagatcaggcagcgagggtggatcctcccatgaaggaaggagagatggtagactacttcttacaaacactggagccaacttactttggtcacttggtgacgacggttggtaaatccttcaatgaagtggtaaagataggagcaatgatagaggaaggactgaaggccgatagacttttgaattattcggcgcttaaagcaacaacccaggctattcagagcggcacgggaggtgcgcttgggaagaaaaggaaagaagaagtggccacggttgatcaggcccatgcatatacccagcctccggctcgcccgcaacggcgcgcgccagctccacaaaatacttatccaccaccaagggcatacaggaaccctgcaggaccaggtttccgcgggaatcaaagagcattcactgagttgggagaaacctatactgttttgttccacaaattaaggcagttaggattgttgagtcctgttgagcgcagattgcccaaccccctccccaaaaatatggaccactcggtaagctatgaatattgttcgggggctcccggacatgataccgagaaatgttggaagttgaagcatgcagtgcagaaccttattgatgcaaacaaaattgaggttcagacaccggaggcacctaacattaatcaaaacccgttgccagcttgatgattggaaagatgctccatcttctcgttagccatggaagagttttgatggttggtttttttgtcatttctgtcatctgggttactttcagggtggtaacccggatattgtcttttgtttcaaaccctcttatccgttttgtttagccgtgttggtttgtttaagtattgtctaggtttgctttagggtcgtaactgtttgttttgttgtttaaacagtttcaccgtttgtttaatgcaaagtccagtctcttttattatttcaatcatcttctttgtttaatctttgtctggtgctggctctagtgacatgacatgtataattctcagtcctatgtgttaagcaataaaatcatcttataaaaacctatggaggcaagtggagatcattcgaagcccgaactatgtgaaaccggggcaataaaagtgggagtgttatccaacggtgttttaaaaacgacaaatgtgtggatatggttatcaagtccgacacaatcagaagatgttgcgaatataattgtgctgtttgcacttggcatgtttttgaagactggaatgacgaaggcattttgttctgctacctaaacagtttatccttcgttaaccctttgagccttatttgatttctttcatacccctctttcggaatcagtagcaaaaattagaaacacaagtatggaagataagaaaagaaaaagaaaaagaaaaaaaaaagagaaaagagaaaacaacaaaaacaaaagagaaatgagaaaggaaagagataaagaaaaaatgaaaaattaggacaaccataggtatgaactacgtttgacctgattcctcaaacaaggatacgtaggcgcctcacggctcggtcatggtgtgacaaaatgtcacgttttgatacaactcactcaccataggtgggaactacgtttgacctgattcctcaaacaaggatacgtaggcgcttcacagctcagtcatagtgtaataaaaataaaaaagatcccccaagcaagtaactggggcaaagtgattccgagggttgtaatcttgaacccatgtttatttgttttgagccttttaataccttttctttctagccctaaccaaaatcccacgttatggtccaaagaaagaccttctgatcagccttcaaaaggcgccaagtcaagcagacggaagttgagaacaacgcactgatccccaaatgaatgatgatcatgagctgaaggaattgatagccaaaagcatccccagtagagagaatcttagcggtaacaccgcaatccccagctggagaaaataaaatgagagagtcttatcggtgaaaaccttcataggcaccgtaaggcgacgaaagctgagagaaaagaccaaaatgagagaggcgtgatagtgaaaacccttcggacactacaagtagtttgagaatcagatgggaaagtaccagaccaaggttgtgaaagatgaatgacagagaatcaaaacccggtctaacggttcaggggtaccgcaagggttgaactatattgcttgacaagaataggccacatatgcatgtcatggtcgttaaagtcagcgtgcatgtctgataggtttttgctttatagtcttcttgttaagagtcatctttttccgtgtcttttactttgtccacttcctcttgagtctgtttggtcagataaataagaaatgacttcaaaatcagccatcagcttcccaattgcgcaagacgagatatggctagaccgaccaacgtactgagccggtaatgaccaacatgctttgagattcacgcaaaatgcccaggattggtctgtatcaattcatagacaatatatcagaaggattaccagggggaatatcatccccagcaaataacaacattccccaacaagttttgggaatgcagagtagggaaaggagaaagggagaaaccatccccagcaggaatggcacgaccactcaccacattttaaactaacaaatttttctttgatttgaagcaggggaaagaaatgttatggatggtggatagacatgccacaaagaaggtcaccaaaactggggcagaaaattttctgccattgttgaaaattttctcgaagaaacgaggaaatcaattcaagctctaagagatggcaaaacaacagaatttcaagaaggacagttggaggtaagataatttcaaattttgatataggttcatccaccttcgaataggatattataggttcatccgccttcgaataggatattataggttcatccaccttcgaataggatattataggttcatccaccttcgaataggatattataggttcatccgccttcgaataggatattacaggttcatccgccttcgaataggatattataggttgtccgcctccgaatgggatattataggttcatccgccttcgaataggatattacaggttcatccgccttcgcataggatattataggttgtccgcctccgaatgggatattataggttgtgcaccttcgaataggatattataggttgtgtccactttcgaatatggtattataggtcatccacattcgaataggatattataggttgtccgcctccgaataggatattataggttcatccgccttcgaataggatattacaggttcatccgccttcgaatatggtattataggtcatccaccttcgaataggatattataggttgtccgcctccgaataggatattataggttgtgtccaccttcgaatatggtattataggtcatccaccttcgaataggatattataggttgtccgcctccgaataggatattataggttgtgcaccttcgaataggatattataggttgtgtccaccttcgaatatggtattataggtcatccaccttcgaatatggtattataggtcatccaccttcgaataggatattataggttgtccaccttcgaataggatattataggttcatccgcctttgaataggatattataggttcatccgccttcgaataggatattataggttcatccaccttcgaataagatattataggttcatccgccttcgaataggatattataggttcatccaccttcgaataggatattataggttcatccgccttcgaataagatattataggttcatccaccttcaaataggatattataggttcatccaccttcaaataggatatacttggttcttggagtaaagttccgcgatagtttaactttctggttgtatgtaacgtagaataaggctaaaatggtttgcgagatggaaaatgatcaagcagaggacatgaacatggaagtggaagtgtttcttcgatgtggcctgaagatatgaatgaagctggaaaacaattcaatatagataattcaggattagatcaagatatgttggaggaggttactatcgataaggatttcacaataattgatttcacgcgcttttcagaacttactaattatagcgaaaaagggtcatctcatttagcctaattggtaaaaaactgggaatataaatagggaaatgatgtaaggctgttcagagagaaagtttgatagtcttagcaagcaacaacaagaatcagagctcaagaaattggagatattggggaagtatcaatttgaggaggaaagatatgggggtgataagtgtccaatctctatattggacgaagaattgaagagatacatattccatgaggttcctaagaaaaggaatgatgtgagagttcaagacaaactggaaatagatgctgagtatgaatgagagctgaacatttggggaagttattggaagcaagcgctcaaagggagcagacactaattgagaaattgcaggaaagcatagaaaaacttgaaagtcagtcctctccaatggaagaatttctaacgaaatgctgggtataatgggtctatccgccctcgaataggatatgatgggtctatccgccctcgaataggatatgatgggtctatccgccctcgaataggatatgatgggtctatccgccctcgaatgggatatgttgggtctatccgccctcgaataggatatgatgggtctatccgccctcaaataggatgttgaatttagtcctttctcaaaaggacatttaatttatttcgacccgagtggtcctactggtataaacattgccaaatatataaatcactgccaaatgcattttattctttaagttgttgatgatgtcaggagtccacctggagaacgaggacacacaaatgaaagcgatcaggagtccacctgaagaacaaggaagaacatattgtgaaagcggtcaggagtccacctgaagaacaaggaagaacatattgtggaagcggtcaggagcccgcctgaagagaggagaggcaagtttattttcaaatatgttgctgaagtcaggagcccgcctgaagagaggaaaggcaagtttagtttcaaagattgtcgttgaagtcaggagcccgcctgaagagaggagaggcatgtttattttcaagacgttgttgaaatcaggaatccacctgaagaacgagcgacatgtactcaaaaccttgaagtccagaatcacgaataacaggtatccccagcagtgaggagaatcacaaacgaaaggtccccagcagtgaggggaatcacaaacaaaagatccccagcagtcccgaaggaaggcaacacgagtccttgagaaagatggtaaagaaggcaggagcccacctgaagaaggcaaattttacttttgcaagatttccgctgggaggaagactgattataagaaaaatccccagcaggacaaacgctggtagaaaaattgtctccccagcggaatcgtcatcatgttttggaaggaggaagcaccaagaagaacacaagtcgacaagaaggcaaggccagcaaaacaagttgaagataggcaggatcatgtgatccgtaggctagcctagcttcttgtttttccttttgatacgatgtaataaggagatcagtaaaatggcggtgacggtatgcagcggcaataacggtaacatcacagcaacccggtagtcccagctaccacttttttcccgaactacattaacctgattcccttttagccagggatatgtaggaaacctttgaagcaaaggttcggttaaaacgttttcaaaaaatgcttcacacggagcatcctaacaggcaaaaatcgctcatgtgctcattattctttgtgcgcaagcccttcgtgcttccggacaaagaggggcagctgtgagcacgtgatttttgctttacggaaattactccaaaagaaatcaaaaattaaaaggctaagtcgccttcgggtgcaattttgagagcttacggacaatttttggtaattgtgtggtccgtaaatgcccactattgatgtgattaaatgaagatataggttgcatgcattagaggttgatcgtacgctttcggaattgattgatcacaagttgatcgaaaggaaattgcgaaagtatgcgattccggttaattttggctaaaaaatgcgatttatgttattcttcatttaattgtgtaattttggtattaattttaaatgtttaattgtgtgttagtgtgtaatttactttaatttagttgtgtttaaaattgtatagtgtgtgcaagccaatgtggctatgtgtgtaagaagaggctaagtttaattaggatttaaaaagaaggaaggtggctagattttaaatgaaaacaggcccagttgagcagccctgaccctcacccgtccaaacccgaccctttccctgacccgtctgcccgttacactccaaacgaccccgttttttagcccccgttttgatctcagccgttggattaaaatccaacggttgaggttaatatctcaatcttattaccctaaactacccaaacccccctgagataccccatttccccaaacacccctctatcttttcttctctctaaaccaaacgcccctcaaaccctagccgccgccgccgggcgattcccaccaaaacccggcggcctgagctcctacaaccaccaaattaacaccccttaaccccctttccttcctctccatgaatcccttacccgttttgcttggatcaccccagaaccctttgaatattagatcgaagtcgaaccctagaaaatccaagccatggatttgcccgaatggaaagagattttgaggtctaattgaccttagttgaaggtttttcggtcgagaacacttcaattaagtcccgtttggcctcaaaaattcgaaatccgtttggtccgagttcatctcttccctgttcatttttgaggtatttgttttcctttccttctcttctatcttctgtttgtttctatgattgattagttgttcaagttcattgtattaattgtgttctaatttttggccgaatgctctgcttttcttcttctgcttgggaccttttatttggtcgacttgttgtttctgttgttattagtgagggtagttgtgaactacataatcgattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatagcttggtatatagctgttgtaactcattgaaatcaagaacctggagtttaggatttttaaaagagttaaaagattgacaattagttggagtggactgacagacagggtgtctgggatgggctttacactttaaaaaagcaaagtggaacctgccattagcacacaaccaccattctttgtttttcagaatctcaactaacagtccatacctagacagtcctaagtgggatagaaagaggaatctccagcctgttaaatgaatttaaacaggctgtaagtcagtgaagttggggttataaagagagtcattttgactaagaaaggggggatcaattttcagagagagctggaaaggaaaagagttttgagtaatcttgagtgagagctctcagagttcttgaactactctatcctcagaatccctgctctaatagtccagtttgatttagcctctatattgatcattgtttagccagcttgattggtttatttgattcgagtgccactattgcattgggtacttcttcctgatcccttcttattggcaaagtcctgcctggacttctactgtttggctgcttgagtttctattggtacctggagtcattttctggccttcttgtattgctcctgggttattttgcttgctgtggaatattggctggattacctgctgttgttgctgtgaccattgcctaattgctgcctgttatcctgataattgatgctagctttctccttttgaaatccaggtacacatctccctgcctggcactgtgtaagctcaaaattgaaaaagaaatgcaaagttgaaagcatgaaggccttggctttaagtcctgtgtagtagtctttctgttagttgtagtcttcatatgcatatgtattagtttctggttaactggaagcatacaactatgtagtttctcaatcttgtatctctacccatgaatggacttatgcatcaattagctaaatgacactataggggaatatgtaatcagtccagttagttctaatagaagttttatgctcaagctcttataagcagattggaactgttgtataaaactgttgaatgcataattagtaaactttgtcgttcatctttacatttagtttcttcttaaaacacttagtctgaataataattgtgaactcaaaagggctgtaacaataacattggatcagacccttaggcaaataggattggcccaggtccaagttacacggacctgggcccaattgaaactgtccaggccaaaaagtgacggcccagacccaaaaatggcaacggacggcccctccccttcttcccttcaaatagcatcaatgaatgtaaataattagaataagccataacaacgagatgcatgtaaataaagttagaatttttattccgttttagagacacgttcgatatagaaaacgtagtcaactttaggatatcctttaaatttcgggctttctttaaaggtgtatatattacaagcataaatagattccgggatgagccgtttagccaatttcacggctttcccaacataataaaacgctagccttctctaggacgcgtcttaattaatttacctccctaaattcgggtttgcatttatgcaacccagatccaaatctcaacgaagtcgaggtatgtcaataaacacggttacaccgggtgtggcgttgtttaggggcatgttttcacaacgttgcaagtcttttaaaagattacaacaataaaagcggttttaatgttaaaaggcacatcagttatagcatgtattaaaatcagatatttggcaaatgcgacaatttaagcgaccgtgctagaaccacgggattcgagggtgcctaataccttccctcgggtcaacagaattccttacttagaatctctggttcgcagacttcaattggaaagtcgaatattttcctcgaattgggattaaaataaaccggtgacttgggacaccaaaagccaaacctttcccaagtggcgactctgaaatcaattaaataatcccatttcgaatattgtcacttaaattggaaaaactcccttgcgcatttatccctcggggtgtgtgcgcgccaaaaggaggtgtgacagtagccatgcaggcgtccgcaggacccgacgtctcctctatcgttattttcagtctgttatctcatgtattcgagacaaacagttttatatttctttcaaacggttacgtttagtattcttagaagttcgtgggtattgtgacaccagtcttgggtagacgtttatgtttggatttttacatcgcatccggtaatatttatttaagtcttccgcgaaatttaattattttgttgtattcgtgttattgtttaataatgttaaaaataagatttgttaaaatagaaaggtaagtaagagttggcttgcctagctcccactagtaggtgccatcacgactcctgatagtggaaaattcgggttgtgacagtgcggaccgaacatctcgtggcggacccaaatggatttcccgaagtatggaattttgcccgtaagtctttgtacctgattagcggagtgcctatttttgtccttgtcctttttatatcttgtagcaaatgttgatctgcttcgtagtctttcacctgagaagttacccccacctcctttggaggagatcagagaatgagtcgaggccgtccttccccataccacaggggttcgcacgtgggcgacattctatgagagattcaggcgtataccccttacgggtaagacaacgtatttattttctatctgtcttcttttgtttttatcttaatcttttgaatgtttgtttgtcgtgtccagggagagttcgcagagtcagggctcctcatctagccttccgtcggccggttgcatttattttctggtaccgaatataaataggttctttcgcagcctaaaaatgaaaaaagcccttaatttttatagtttacttcttaagctttttctttcttccctttttaccatcaaatctctcctcaaagaaaaactatatgacattagctaccacaacataataaatgaaacacaatatacttcaccctattttctaccaaaaatattggctggggggtgaaaataagtgttcaaaatcttgttcataactgttttgaggcagcaaagattcacgaggaatccaccatacggagctactcccagtctcggaatcccaaacggacatcaatagcactgaaatgcattttaagccaaattgattcaatttcttctaaaatgatatcttccataataggcgccaaaacgctcccgggttatccaaaactcgatccaggcattcgcccaagtccgaaatcatcatacgaacctgctggaaccttcagatctaaattccgaggtcgtttactcaaaatttcaatctcagttcatttgttcaactttaaactttcaaaatgagaattttcatttaactttgactccaaacttcctgaattttaattctaaccatacacacaagtcaatatacctgaaatgaagctgctcatggcctcagattgctgaatgacgtgccggagctcaaaacgaccgatcgggtcgttacaatctcccccacttaaatatacgttcgtcctcgaacctgctgtgaactacactgaagtagtctgaaatcacttgtttaacacctcatgcaccttcctgtactagcacaattcagttgagcacattagctcgataactctgtagatatactcctttgttcaagctaataagccattagggccaattccacatccgaaatttcctgccaagcatgtttctcacatacgatcaccatatcaatcatttcacgctgtacccaaacataactgcataactttgctgaattcacaccttgcatcaccttgctcataaggccacaataactttttttaactatattagtcgaaattccaccaatctgatgctcccattgcctctcttgacctatataggtcttgccctagcttttacaagaccgatacgacggaaaagacgtgccgaaattcataatcaactgctgaatcaataattcattgggtctatctccctgacaagcatcatcgcctcatcatgaaccatctaatggtcttagctccttaatatgcttcatataatcagattgcactgtctctaaacccaataatctcgtttcaccagcacgaactgctcaggcaataagccatcccggacatgatcaaaagtctaatattatgccacaatgcgccaataggctaccattcgggttgcaatacacaaaggaaacctaactttaaaaagagagatctaattaccccgctcgcgaaccatatatgcgacgcgtgcttacatctagaacataaaattctgggaaacataacacataagagcaaatagaggaaactgtactgaacatcatactgttgcggcacgcaacccgattcgaacaacataactatggcggcgtgccacccgatccatacaatataaccatggcggcgtgtcacccgatccaaataacatacctatggcggcgtgccacccgatccacatataaaactcacataaggagatatacattgagctaaatagctcatcacatccaaataccgagtatcggtcataaacactctaaggtgcataatttcatccctaagggaacatatagcattataggctacaaaactcgagcacaacggaggtgcgatacatgatctaaatctcaagagccatcctgctcatataacatcaccgttgagcggaacctcaacacataagaaattaccaagccatctcacaatgcatacagcgaaacatatctttacatgaattagctggccacaaaataacaccatggttactcttccataaatagcgcattgccgaaataaatacaactggcctgacatagagcctgtattcacatcaccaacctcaagtcggtcctgatcctgccaaactaggtcaataacctttcaaaggtccataaatcaataaacagagtgccctccaggcataaattcttcaaatcgatgatattaccaaaatcctcatacttggtttaaatttctaatcaatcaagtgactaaatgtcacacttatacaatcttcctgtgggaaaagcaactcccaccctcttccgaaataattaacgggttcgcatattcaaactaccggctgcactaacgctgaaaagtgatcaagaatccttaaccaggatgcaaagcctttcttatcaaacaaagatctcaggtgatactggcgaccataccaacttacctaaaacactgaaactcctttcctgctcatccgagctcgtgacatcacagtcattgaccaaacagcaaccttggtccttatttcaaattccataccactcactgcacctcacgtgccgatatatgatagacgcgatttccatcacaactctggaatcgccgataagctaacacttcatcatataaaactttccatttaactcacttcaggagaactatggtaacatacaggcgaattctcataaccgacgaatatgccaactcaactatggctaatcaatctgtttccttccaatttacccttaattgccttggaaacaatacctctccattcaatacataacatacttcatcttcactcatcccgagtgaccttgaattacgaggccatgctgtttcaaatcccacgaaccatttcatatctcccaaatgctacatcgcaagtcaaaacaccatagaacactctgtgcctttcttcataagctgcttcaaaagcttgtctcttatccgtacttatagactcaaaattattaggcaccacactttacctcttgaattcatgaggaccactattgagagccacccgctctgacttggccccgaatgcaaccaactccaccaaaattttttttaacatatgaataccctctcgataaagcacccagcgggatcacttccctcgaagcctgcacctatacgaggcataaatcatgaatttcccttcaagtctgaacatgagccaataaggcctaccataacatgctcttagcaatccatctgctccaattacctcttagagtcttttctcataactgaaacaaccctccaatatactcatggaggaaaacctcgcaagtaattcttaaccttgcgcaatcagccgccaaaattctcggaatcattcggtaaaaaccctcttttgaactctgattcatcaaccccattcgcacggccgatcatttcgctaaataaccgatagaattccttgcagaagcttcgcccaccacgcgaccgctaacctgctcacagggaataacccacttgtagaagccacttccaacatcctttaatgttgctgcacgaggtatatcattttgacatcaataacttatcctgggtccaagcttatactctggctgcaccggtccatttacctcccgtggacatcaattaaatatgcggcaatatccttccaattcggatttaggctgcattcttcttcattccaagcagctcctttttgctatatcaaatctcttgccgcataatggcctatgcttcaagttagctccgtaggccccaattactaatctccgaaattctccactcattccaaactctccttaaggcgcgtagtcatcctactaccgagcctatatggcacacccgccgctttcccactttggcggaactcattcccttaatggactacttgaccttgctcctcgtacttggccttcttgaagtccttaaacaccgcctgacacttcccacatgtcctttctttaaataaaatttatcttcatagcacttgaacccacaagtcactactaactttcaacctttccaaggatcatctttcctaagtcatcaatattagggtcaccgattccatcctgaactaccgcatcccgcgatctctgactgtcgcttcttcattattaactcgcaatcttctgcattatcgatatggatgacgcatggtaacaatggttgagcaaattcttggctcctttgaaatccttctgtagcatcaagaaccgtcggcgcataattaataccgagtgcccaattttaaatacatgagtggatgtacaagtacatatgataaaggctccagctgaataaatgatgcacgataaggaatggaatgaagtggaatttttcctaacggttatatagcccttcgtagataagtacagacgtctctgtaccgatcaacgatgctctaataaaccgtcctgtgttccgtgactcctatgaacctagagctctgataccaacttgtcacgaccctagttcaccgccgatgaacatgtcatgatggcacctggccggcgaggccaggtaagcctaactcgctgcggattacaatatttcacataagaagagacaaaatcactgaagtaaacaagaaatgtaataagttccacccggcacatacacttagcatctataacccttccgatatcattcccaaaacccggaaactcacgggcaacacaggcttaaaactttgaacataacaagctctaatcattgggaaatctaatacaaggagaaaatagaaataactactatctaactatggatagaatagaaggagagctcgtaggatctgcggacgcggcagatgtatacctcaagcctcctggaaactgccccggactcactactgatgcgccgtgcaggaagtacctggatctgcacaacaaaagtgtgcagaagagtagcatgagtacaccacagcggtactcagtaagtgccaagcctaacctcggttgagtagtgacgaggaaggtcagggccctactgagacaaatataatgataaggctgacaacagtatgaaataagcagaaataatgatatacgattataaattaaatcggattgcacaaacagccatttatacacagaaaataggataagacagagtaaataactcaataccaatacaaataatgaggatctcccaggataccatcctgtagtccattttatcaatttgtacgaggatctcccgggaatctaacccgtagtccaccgtataatatatctgaaggatctcccaggatatcgtcctgtagtcctttgtatcaatctgtacgaggatctcccgggaatctaacccgtagtccaccgtataatatatctaaaggatctcccaggataccgtcttgtagtcctttgtatcaatctggtactgggagaatctaccggctgcattgctatagttccatataattgtgcagggggatctcccgggaatcgaacccgtagtcccaaatataaatgtgtaggggatctcccgggaatcgaacccgtagtcccaaagtaaatacgcagccaagttccgagaaatattcagaagtgaagtacatcaatataacaacaactcaaagtatcaagtaattaccaaactcatggcaaataatagtagattctagcctaatatgcttcatagaatgcaagtaaggcaatttaagaaaatagccaagtaagtccactaaacatgtgtttctatactagcacaagctataataataagtaggatcaagcaaatacgaaagaaactcaactcaagtatttttaagaaaaattcggattttcaacaattagctcaagtacgcgctcgtcacctcacgtacaaggcattcaattaccaatttcatatcctaagggacgaagtcccccacacaaggttagacaagccacttacctcgtacaagtgcaagtcaacctgaaatcacgctcttgccacgagtatccaactccaaatggctcaaatctaatcaattaaattgcataatgtaaataataattcaagtaatttattctaccattaaattctaagctaatacgcaaaattatgaaaaatgaccaaaatgccctcgagctcacgtgcccggaatctgaaaattcttgaaaataagtattacccataacctatatagtgtatatctagaaaatcatccaatttcgtccatgaatcgaccctcaaatcaagggtttaccatttttcaactttagggctcaaaatctccatttctaacatccaaacaccgataaaaatataaaccaacggaaataatcatggagaaacataaaacataagggtcagatacttaccccctcgttgagacgagaacaacgccgcgaaatcacctcaatcggagctctagaactcaagttatggccaaaataccaaacccctcggtttatacactgaccaggtcgcttaagcggacctttttccgcttaagcggtcattttgtcttatctgggaccgcttctgcggtcttttgtccgcttaagcggttccgcttacgcggtcaaagtccgcttaagcggttctgacagaagcagacttccctcggcacggaaacgagcataacttcctcatacgaactcagaatttggcgattctttttcctatggctccaaaatttcgatacagatctattggtttaaacaaaactgaatttggagctcatttgattaatattatacccatttatgtccaaagatgcaatattgaaacgtcgaataagagtggattcacaacccgaaacacacccgaggcccccgagaccccaaccaatcataccaaccagtcccaaaacacattacgaacttgttcgaggcctcaaatcacatcaaacaacgctaaaatcatggattaacctccaatccaagcttgatgaactttgaagtttccaacttctatttccgatgccgaaacctatcaaatcatgtccgattgacttcaaaatttgcacacaagtcatatttgacattacagacctactccaaccatcagaatctgattccgaccccgatatcaaaaagtcctttttcggtcaaatttcttaaaaccttcaaatttcataagctttcaaatttccaatttaaggccgaaacacgtcaaacaacgtctgttttcaaccaaactttataggaagcgcttaaccaatatatatgacctgtaccgggcgtcagaaccaaaatacgagcccgataccattactttatgatcaaatttcattttcattttccttaaacattttcagaaaacaatttcacgaaaaaaattcatttctcgggcctgggacctcggaattcgattccggaacacgtccaagtcccatatttttctacggatttttcgaaattgtcaaatcatgggtacgagtccgtttacccaaaatgctgaccgaagtcaactatatcaatattaatatcaaaattcttcaaactgctatccttagccaaatggttccaaaatgacttgtggacctccgaaatcacttccgatcgcgctcccaaatccataaccaccatacggagcttactcccagtctcggaatcccaaacggacatcaatagcactgaaatgcattttaagccaaattgattcaatttcttctaaaatgatatcttccataataggcgccaaaacgctcccgggttatccaaaactcgatccaggcattcgcccaagtccgaaatcatcatacgaacctgctggaaccttcagatctaaattccgaggtcgtttactcaaaatttcaatcttagttcatttcttcaactttaaactttcaaaatgagaattttcatttaactttgactccaaacttcctgaattttaattctaaccatacacacaagtcaatatacctgaaatgaagctgctcatggcctcagattgctgaatgacgtgccggagctcaaaacgaccgatcgggtcgttacatatagcctgataggccgaagcttctccaactctaaaagcactatttaaaaaaagtttttttttttcaaagatgaataatttgaccaagcttttggaagaaaaaatgtgcttttaagaagaagcagaagcaattttgaaaaaacagaaaaaagtaattgtagacatgaaaaaattatttaatccatacaaaatttggattaaattctaaactactttgggtcgaataatcaatttgggctttacaagttaaattagtccattatattattttcaggcccaaagtccatttcatcttaaggcccagacttatgccatgtgacatggcatatccagtcaaactctaggccaataaggtgacaccacatgttaaataatgtggcaatccaagtcaaaaagcaagaaccaaccacaagtctccaagtggcaaaaatgacacgggccaatcaaaatcaagcaagagagtcttatggagcttgactgtccatcctctacaactataaatagaggggttacataactcccaaggaacattcagagttggataaaaacactccgcaattggtgaaggcatccacaaacaaagatatcaatcatcaagtgcttagttcttcaacaaaggagtaatcaacggagttcttcccggagatcgacccgtaacaacaaagtgctgctcgacgtacttggagattaaatacatcactagaaggtctgcattatcctacattcgaaaaagatgcttcttaagccctcgaatcacggagaattttagataggagaatcaagggatacatagaattgtactcacaaatatttatcaataaaatctctttttcttactattatttttgttgcagtttatttttcgtcttacgaaaatttattgcaaacaaattttggcacgcccagtgggaccaattctgcctttcatctttccttcttgcaagttgaaaactagaagcttcagatctactgctacaatggccttccgcaagtttgttgttccatgcaaaggtgctactgttgccgcatccgttgagctcggtcatgttggaccaatcactcaaagcaagttcaaggctagtggcttggatggatccgaatacttccctgaagatagcaaagaaaagcagatctcatatgacgttcgcaaccgcaatctctggggggcagcaccccattctcgatgtttgatgaactttctcaagaagcttcaaaccttggcggatttgaagatttggtggattcttcagtttcaacgaaagttaacgccttgatgactgatgcaactaacgtggacgaaaagtttgccatgatgaaacaaaccatagaggtcttgaagaaatctgttgaagacaaagaccttcaaatcactcaactcatgaacaaatcggaggcctatgcaccaggagagtcaagccacgtccctcctcgttcacctgtcttcacctctccaatgacgactatcgaggaatcacttgccaagttcaacattcaaaaggaaaagcaatccacttcagttgcggcgttatctgtccaacaattgcaatacatgataacaaacaccatcagagctcaatatggtggaccatcgcaaagttcgttgtactactctaagccttatactaagaggattgactgtctaaccatgcccacaaattatcaaccaccaaagctgcatcaatttgatggcaaagggaacccaaggcaacatactgcccactttgtcgagacttgtagcaatgctggaacacatggtgaccttttggtaaaataatttgtctgttctctgaaagggaacacatttgactggtatattgacttggagctcgagtccattgatagttgagagcaacttgagaaggaattcctcaatcatttttacaatacccgaagaactgtaagcatgatagaattgacaagaaccaagcaaaggaaggacgagcccgtggtggattacattaatcgttggagggcgttaagtttggactgcaaagatcgcctttcagagatatctgctgtggagatgtgcattcaaggaatgcactggggccttttgtacattctgcaagggatcaaaccgcgaacttttgaagaacttgcaacacgagcgcacgacatggagttaagcatcgcgagtcatggaaaggcatctccatttgctgatcagaaggagtacaagaaaaatatcgcatcaaagcaccaaactaaagaatccatggcggtgaaagcaacttccgtaaaagtcacaactaagcaaaaggtgaaggaggataagaccccaagtcaatatcccaaagaggagaaacgtcgtcccacgttgaaggaattagaggcaaaggtttatccatttccagattcagatgtacccatcatccttgatgaattgctcgccaacaaagtcatcgatctccctgaataaaaaaggccagaggaaattggtaaacttggcaatccgaaatactgcaagtttcatcgcgtcattagccaccctacagagaaatgtttcgtcttgaaggagaaaatcatgactcttgtaagtgaaggaaaaatcatcatagacatggatgagactgtagaagcaaatcatgcaagtatcgcgctcaaagaaaaggagtgttccaggttgcagaacgcgccaagcactgccttcttacaatttggaaatttcgagcccgttgaagttgatcttccaaggaaaactcttgaaggttcactggagctggacactcagtccaaagacaaagatgatgagggttggactctagtcactcacaagaaacgaagacatcaaggagttctaaggctaccacttcctaagccaagagcaaaaataaacgatgtggagaggctacaaccaccaagaattatcaaatcttccattagcaagaagattaatggtgccttatcgccgaagttccgaaagcccatcacattgcatgaattctttcctggaaaattcttttatggaggtcatattagtgcaactcatgttgtttctagtactgacgaaacaaaggaaagcaacgatgagcttgctctaatgaaaatacaagaacataatgataacagaaaatttgttacatgttgtgcaacaatttccttcacggatgatgacttgctgttggggtctaagtcacattacagacctttgtttgttgtagggtccattagggaacaacatctcaatcgcatacttattgatgatggttcgactgtcaacatcatgccaaagatcatgctaaaaaaacttgggatctctatcgatgagctatccaaaagtaacctaacaatccaaggtttcaaccaaggaggacaacgagccataggtattccgtgtaggattatccattggtgagatgaattcaaacaccctgattcacgtcatagatgctaaaacatcatacaacttgttgcttggacgtctttggattaatgagaatggggtggtatcatctactttgcatcaatgtctgaagtacataagagatggtgagatagtcaaaattgatgcagacatcaagcctttcactgagacgaagtcatactttgtagacgcaaaattctacctagattcttatgaactaaaaatggagaaaccatcatcagatgacgaagccggtgtcaactaagaagtggaaaatgaggctcaatggacttttactaagctgcctaagaatgggacgaaaaagtctccattaagctatcatcatctcaaggtgacatacagacaaagactgaggagcatctggtttttcgctatgttccacgcgagcgtcgacaaaaagggcaacctttgctacaggaatgtactccaaagaagaaaatgagtcacaaagatatccaatatttgaaggaccatatgactgtcccagttgcacaaatcccatccgtgactggtgagtctgctaaaggcaattcccaagctgataaaataaaagggcacgatgatcctaaggccttcatactgcttgaaaagtctggttatgacttcgccaatccatcacaactaggagtctcaaagacgaagtcactggtgaaaagatacatgggctcaatgagtctcaaatgaagttaagaaagcaaggggcactacgtcgccactccaaagtatggattgggattcagtttggcagagcctcttcgaatttcatctaagagaagcaaagagataacttcatcacaatacacctcggtgggggagatgcaggaagttaagggcaagaaaataaaacaacagacttcagtgttcgatcgcattggaggctcaacccctcaagtctcggtgtttgaaaggctaagtcacaaaggtgaacatgtatcttccaaacatctaaaggaagttttcactacctcaaagacctctgtcttttgtcgcttgggaaccacaaggaagtcaccatctaggaagatattggcaaaacataaggatcaagtctatgaggagcgggatcattttgaagttgttgctgacaaagaaatttgtagtgctttcccatcgcgtatgaagaggaagtctattttgtcaatatccacagatggtccactgaaggtgcaaaggagaaccattgtttacacttgccaggctcgtaaagaagcagagaaagagaaagaagccatgccgactatccaaggaagtcaaacagaaaagtcagactttgtggaaacatcctatcacataactgtggaagatagcccatgccttgacgttgatgatgaagtacacgaggctccccctcaactagaagatggcggacaatcaacggtggatgagcttaaggaactcaatttaggcactcctaaagatccacgccccaccttcattagtgcgcttcttacgcctaaagaggaggaagaatactccaagttgttgaccgagtacaaagatgtcttcgcttggtcgtataaagaaatgcctggtcttagtcctaaagtagttgttcatcatttagggatcaaaagtggagcacgccctgtgaagcagtcacaacgcatgtttcgacccgagcttgtatcacaaattgaagtcgaagtcaacaagctcatcgaagcgggatttatttgagaggtgaagtacccatcatggatatcgaatattgtacctgtcaataagaagaatggtcaaatacgtgtttgtgttgacttttgagacctaaacaaggcatgtccaaaagatgacttcctactactaattattgaactcatggtggatgctacaacagggcatgaggctatgtcattcatggatgggtcctctggatacaatcaaatcagaatgtctccaaaagatgaagagtgtactgctttccgaactcctaaagggatatattgctacaaaataatgcccttcaatttgaagaatgctggtgcaacctaccaacgcgcgatgcaaaacatttttgatgacatgcttcataagtgggttgaatgctacgtcgatgacttagtggtgaagacgaagagtaggcgttaccaccttaaagaccttcgaatggtttttgaaaggttaagaaaattcgacctgaagttgattccgctcaagtgtgcatttggagttacctcaggaaagtttcttggcttcattatgtgtcatcgtggaattgaagttgatcctgcaaagattgacgccattcagaaaatgcccacgccaaagaacttgagggagcttcgaagtctccaaggaaacttagcattcatccggaggttcatctttaatctagccggacggtgtcaacccttcaatcatctaatgaggaaggatatcccttttcattggaattagtcatgtcaaaatgcttttgaaagtatcaaaacatacttgctgaatccacctgtgctaggggcgccaatgcttgggaagccattgatactctacatcgcggcacaggaacattcacttggagcactacttgctcaagagaatgaggaagtaaaggaacaagccttgtattaccttagccggactctaataggagctgagatgaactatacgcatgttgagaaaatatgcttagcgttactttatgcgataaagaagctaaggcattattttgaagcatacaccatcaaactcatctctcgagcagatcccgtgaagtttgtgatgactcgacctgttctttctggacgcctagcaatatggtccatattgtttaaccaatatgagatcacataaacacctcaaaaagatgtgaaaggacaagcactagccaattttctagctgaccaccctcttccggcagaatgggagctttcagatgagtttccagatgaagatgttttgttcatcgaagaattgccaccatggataatgttctttgatggatctgcacgtcgtaatggtgcgggggcaggtgttgtgttgatctctctagaaagacaagtcttgccattctcctttgttttaggtgaaacatgctccaacaatgctgcagagtaccaagctttgatcgtcggtctcgaaatggcattagaaatgaagattctacagttggagatctacggcgactctaagccgatcatcaaccaacttttggggaattacgaggtaaagaagaaagatctattgtcataccatgaatacgcttctggtttacttgaaaaactcgaccgagtgttcttaaaccacgtccaagagaagaaaatcgcaaggctgacgctttggctaacttggccacgacgatagcacttggagagcacaagtcaacaaaggtatatgtgtgtcatcgatgggttattcctagacttctggatcttcaaattaacgaaagccatcatacgtctgttcgagtgattgaagaagaagattggaggcaaccattgatagagtaccttgaatatggaaagttacctgaagatccgcgacaaagaacaaacatcaaacgaagagcaccatgattcatcttctataaggggacattgtttcgccgctcttttgaaggactattcttgcggtgtcttgacaaagaagaagcccgccaagtgatggaggaagcacattctggctcatgtggagcacaccaatctggtcccaagctccattttcacatcaaggggatgggctactactgggcgacaatggtgaaggattgtatggatcatgccaaaagatgtcaagcttgtcaatttcatgccaactacatccaccaacctccagagccccttcacccaactatagcttcatggccttttgatgcatggggacttgatattgttggaccacttccaaagtcatcaaagggacaaatgtacatactggtcgctacggactacttctctaaataggcggaagttgttccactcaaggaggtgaaaaaggaaactgttatcgattttatcaagtcatatataatttttaggtatggcataccaagatacataatcactgataatggaacgccatttgacaacaagctcgtaaagagtctgtgcgagaagtttggtttcaagcaacatatgtcttcaatgtataatgcacctgccaatggccttgctgaagcttttaacaagatgcttggtaatcttttgaagaaagttgttgcaaagaacaagagagactggcatgagagaattggtgaagctttatgggcataccggacaacatttagaactgctacacaagaaactccttactctttggtatatggcgtggaagcagtccttccattggagcaacaaattccatcacagcggatagcaatccaagaaggactcatgtccgaagagaatgctcagcttcgcctagcagagttagaggcattggatgagaaaagattggaagtgcaacaaaaattagagtgctatcaagcccgactagctagagctttcaacaagaaagtgcggccacgatcattccaagtgggagacttagtcctagttgttcgacgacccataatcctcaacaaacgcataggtgacgagtttacctcaaaatgggatgggccatatgttgtgaaggaagcctattcaaatggcgcatacaaaattgtcgataaggatggtctcagagttggtccgatcaacggaaaatttctgaagcagtacttcccatgaaagtcacctacgctcctctcaacgtacgagcctaaactgctagtcatgacgctccttaatgcacgagcttaaactgcacattgctacactcctggcccccatgagtttaaactgtgtatggcaaaaaaaaagagtctgctaggttgaaaacctcgaaagaggcggcctaggcaaaagtcaagacaaaaaaaaaaaacaaaagtccgctaggttgaaaacctcgcgagaggcggcctaggcaaaaattaggacataaaaaaaactcatccctctgaactacgttatgacttgatcctcttcactgaggtacgtaggcagcttagagtttcattctaagttcagtcgcatgagttttaaaaaaacaaaagtttggcgtcatcggatcattacattaattcttccaagtatagaggcacatatctatgaggaaaagagataattttctttgaagtataaaagatgttttattgcttcaatagtacaaaagttgatacataaaaaaaaatatagagacaaaaggaattagacgttttcctatacaaaagcctaagtcatgaaaataatcataaactaggctttgtggccgacttgtcttgaatgcttcttccaagtccatatgacgtctccacattttaatacactatcctcaatgcctcgtatataagaagtcatctctcttgaaaaaaaccttcaatcaccacgggagccgccattgataaatttcaagaccgacaacaaatcaagtgcaaaagttggtgaaggggtgactccgcatcttgtgtgacatctcagactgatatctggactcatcgaacttcttcgaaagtatgcaaaagaaataaacaaagagataagattcgtgatgatagccgaatccattacaaggctgtaaaatcaatttcaaaaatatttgttaggttaaccaagaatgaatggagcttcatcttcaacgagactatatttctcgacgtccgaatttcataggatcaaactgttggtgatgtcgaggctcctagttcaagatacaatttttctggccaaaagcacgcaaacctgaaagttccctacggtcagtttgactgtcaatatttttctgtttctaggccgagaagagttctaggatggaattttttatgttttcagctctaggagttttctttccaacggaacaaacggattgtattccgatactcctagctcaagatacaactattttcgttgaaggtacgcaaatctgaaagttcactgcagttaagtcgatgtctcgaattttctgttgatagcctgaaaggagttctgccatgacatttataggtccttcagttctctgagttttatttctaacggcgtaaacagattgtaattctgtcacttgtagctcaagatatgattttttttgccggaactacacgaatctgaaagttactgcaactaggtatactttgagaattttttgtttctatctcggaaagagttctgctacgaaacttgtatgtattgcagctctatgagtttactttcaaaaagcacaaacggatcacaatttggagtttcctagatcgagatatgaatttttccaccatagcgcgcaaagctgaaaagcaatttcgcggacagaaggatcaagttcagaaagttgctgcggacaatctgctaggaattcttctatgatatcttgaagacttcattatctctgagtcttctttccaatagcgcagacggctcgcgatttggacgctcctagcttgagatatgcgcattccaatgatagcatgcagtgctgtgaagccaaaaggacagacttgtgcatcgccttcaaaagttcattccgacttgtccttatggaatttggccccaaattttggatatgtcactgtggtgcaagtttttattctgcagaaccaagcggattgcaatttggatacttctagatcgagatacgatttttttcaatgcgagcatgaaaggctataaagtcaaaatagcagagacgcgtcaagtgcttgctcgccgaagttggaaaagcctaccccaattgtctccctcgccagcctgcaacaatatgatatggtacatgtcgcactcacttgccaaggatgaaatatgatcactagagctccaagcctgtttctcgccaagtcacaaggctgagatgtaccatattcttgctcgcatgttgcaaagtggggatatggctcgtcgatcaagctcgctaaggaatactctatatgtctcccgtcaagctgcaagaagggatgtaccaagttgctgttgtactctcttgaaaacctgcaaaataagaaaagattttggagccctcggtgccaacaagatgatgcttttgcagatacagtgcgggtagcataacgattagctcgattaatgaatatcggtgccatagtacgacgtttctgcttttatagacacgatgtcagtgatacgaagttgttgatcccacatgattgattggtgccaatgacacaaagcttcaattcagcagcaagtacatcggtgccaacgacacgaagcttgaaactatgaccaagtttaatatcaaaacatgtgagaaggaatatagaaaagaaaatatgcgagaggaaggaattacagatgggaagagttttgtgtatcttctctcatggttagccgaacttctcgaattgcaagtttgtgctctgctgaggtccagctcttgtactatttatagagcttatgagaggcggtgtcttacttggtgtgcaagacttccatattaaataaaaagagaatttttagttaattatagaatgtcttattctttaaaggaaaagattcaatccaataaaacattgtctcaaaatttaatatgcaacaccggttatttaactagaatctgcttgtcactataattatgtggtttcacatattgctcaatcaaagtgcatgagcaagtgttattgttaggagactaagaaaattattgtcttcactggtacttcaagcctcgtcgctaacgcctatcaagtttacatctcgacaaatcttgaagtagggagcatctgtagacatgtaaaaattatttaatccatataaaatttggattaaattctaaactactttgggtcgaataattaattttggctttacaagttaaattagtccattttattattttcaggcccaaagtccatttcatcttaaggctaaaatgaaatggcaataaggtgacaccacgtgttaaataatgtggcaatccaagtcaaaaagcaagaaccaaccacaagtcgccaagtggttaaaatgacataggccaatcaaaatcaagcaaaagagtcttatgtagcttgactgtccatcctctacaactataaatagaggggttacataactctcaaggaacattcagagttggagaaaaacactccgcaattggtgaaggcatccacaaacaaagagatcaatcatcaagtgcttagttcttcaacaaaggagtgatcaacggagttctttccggagatcaacccgtaacaacaaagtgttgctcgacgttcttggcgattaaatacatcactaggaggtctgcattatcctacatttgagaaagacgcttctcaagccctcgaatcacggagaattttagataggagaatcaagggatacataaaattatactcacaaatttttatcaataaaatctcttattcttactattatttttgttgtagtttatttttcgtcttacgaaaatttgttgcaaacagtaatttctctcgagaagcacttttttgaaaaatatttttcagaaaaatatacttagaagcatttttttaaaagtttagtcaaacactaattgatgctcagaagtgtttttcaaataaattagcccaacacattcaaaaaagtgttagtgagaaatagtttgtgtttgactaattaatttgaaaagcatttttgagcagtaattagtgtttggccaagcttataaaagctacttctaaatgtatttttctcaaaagtgtttctcaaaaaagtacttttagagagaagctccttttctttgcttctccccaaaattaaagcacttttttccttctaaaagcttggccaaacacctcataagttgtttcttgcgcttggccaaaagggcgattagtctatgtaatacaactacgtataatattaatattaagatcattgtcaacaaaattagatcgtttgcaccgactttggattcaagaagatcgaccgtagaataaggaatgggaagagagcgagagactctacccctcatacccaaattgaaaattttggtcctttataaattaaaatttccctaataatgctaaattttccagatacatcacacttacaatggctcgtactaccacaatatcaacctttatacatcaatattaattggaaaaaaaaattacccctttctttaaaccaattagtagaatttgacaagtacttaggcttcccaattttccacgaaaggacgactaaatttgggttttaatttatatggctggtagaattgctcttgataagtccaccctaaataccaccccaaaccaaatcatgcaatatatcaaattttccatttatattgtaaattctattgatcgcattcggcgtaattttatgtggaaaattactaaagttcgcaaaaaattgcatctaattaactggaacactattacgtacctcgtcgaactactttttattgataggtaaaatattattaacatgcgtataacttcaatttaaattgtttttttttttacatcatatttaacgtaacgtacttgcaccaacgtatttgggcaaaaacgtgacgacacaaataaaaatgtaaaaattgaataattaggacgttgattagggtttcttgaagattgtttgcctttaaaattattctactctgggcatatgtcaactatttcattggtttcaacattaattagtacaccttttctcgacgtaagagtttgaataaagagacaaaatcatgcagagagatcgatagccaaattttagaacaagattgttgagtcctgcaataaatttagaaaggaaaaaacataaagaagagcactaaaaaagcagaaatatatgaacacaataagataaaaaaaataacgtacaactgaagcaacagtaatcagaggcggagttagctttataggtgcgggttcggtcgaacccagtcacttttatttaaaatattatatttatactaaaaaaatcattaaatatgtacaaatatttaattgcgaacccagtaagtaagacgatctatcggttccgagataaactcagaatccataaactttaaatcctggctccgcctctgacagtaattgagggaacttttaaacacttgttaaggcctcatttgtttgcacttaatggaagtctgaatcttaatcattcagatctcagatattaagtgcgtttgtttttaaagtctgaatcttaattattcagatcttaatcattaagtgtgtttgtttttttacttcacaatcacttaatgtgtctgaataggtctgtatgattaagatccataacagagacttaatttcattaagatgctatcacatattcattataaactgctgtcacctcctatcattatcaattaccaccatgccaccatcaccaccaccaccaccaccccacccactgccgccaccacctccaccaccaccccaccatcatcctcaatcatagccgtcatcattatcgactatcaccgcctactatccccaccactccgaccatcatcattctcacccacaatcaacactcatccacctcaactaccacaactaccacaactgaccatcccatcaccatcaacaaccacagccggcactgcccatcattataatctatcaccacccacccaccacctttctcagtcacaactactaccaccacccgccactattaattataaccactcaataccaccatcctcaatcataatcgccactactaccaatcactactagctactagaatgaaccaccatcatcaaccaaaactaccaccaaccactgcctctagtcggcattcacccgttagccatcaccaccaacaactatcatattttaataaactatatattttgttgatagaatattagattagttagtatttcatttgagttttatatttattaattttcaaataaagataaattttatacattcggatgttaaaaatcaaacagtcttaattagttctattcagatcttaatacacatcttaatatattcagatgtgtattcagattcagatgtcttaatcttaatacaaatcttgatattcagatgcgtattcagattcagacgtcttaatcttaaaaaaaacaaataaggccttcatggtcaattggtcatgaaactttgctttgtattattggtcttgcttgataatggtactatgtattttcaaaaattaagaatcaatacagttgtattattaacggtgaagccaaaaatttcccaaatttttttatcatttttcgaaataagtctttggccataaaattttcaatttcacttgaagatgaattttgaaatttttcgaaaatttgagaaactccaaaaaattgttttttaaatatttcactcatattactcacaaaaataataaaaaattatattcatgtcgaaacacaactctaattttcaaatattattttcatttgaaaaagttttatttttttccgtaattttataattcttatgtccaaacgtacactaagggctcgtttaatatgaggaataatggataattaatcctatgattaaatttgagatgagtttatctcatatttggttgggacaaaatcgtggcataactaattacgaaattaattatcctgagattgttgtgcgtttttcctccttaggagaagaataactaatctcgagataattaatcatgtgataacttatttcaaaacaaaacctggaaagatgttattccgggattagttattccacctttccacggggataaaaaactattacaatcccaaaataattaattccagaattaattatattataatttttttccaactaaatataaaataaactcttcttaaatttagtctcgaaattaattattatttgtccgtttgaaccaatcgagtaagggatatagctaatttggaattgctatcccaagtggagtagaagactatatgaagtacatgatctttattaatccgaatccaaatctgttccagtttcatacggtgacacgtgtcccttctatttctttttttaaaaaaaacatccgaatcacttctctttaatttaattaccaaatagaaaaataaaaaaagaactcctccgccttcccgtttcccctcttttataggttgcagggtttggatcgtttcgatcaggaacgaggtaaattaattaatttttgtagtttataatctatttatttttgcaatttgtgtaatttttgtgttcttcctcattttttgtgtttataatagacaaagtttcagtctttaaacccttaacgaacataaaaatatttttaaaaaatccaaccttttgttcctagttttcttcttctttttttcccgtaatttgcttaacaaattccaaattttggaactttttttttttgttgttgttgttgttgttggtaattcactaatttgtttaccatgttgttctactataagaattaattataccctacaatagatattccgaagtggttctgtttaccatgtcattggttctgtttataattaacatactatttggattgttgttacatgtcgtttcataatgtatcctgttgtgtacaggggcgcaagggggcttcgccgaaaaattacaccttatatataaggcagaatctgttttttacctctatatattaagtttcatatattaaattttgaacccctttaacacaatccaaaagtgtagtttagtggtcaagggggttcgaaatgtaataaggtctgggttcaattcccactagctacaaaaaaaaaattgaacccccttcgtggagatcctgcctccgccactgattgtatagtcctgtattgtttaatgaatacaatgtttggatagatcgtattgttttccatcgtttcatgatgtcatgcaccaataatatgaagaataaacttgcaatattactaagaaaaaataggatacgaagtagaattattgtataaaaaaaaggtaaaggatatgattatttaataataaggaagggcaagatgagagaaaagagtaagaaaacaacgccaccactccgaatccgtcgttccataaagtggcatttttcgttgtttcgtaacgacggatttgacgatacaattcaatatattttaagtaacaataaaaacatacattgtatttaaagtaacaatatgatacagtacaatgggtaacaaccatcctaacaaactgaggtagtggccacgtagttgtttgttgccgtttcccaccttaattgctcataattatcatctaatattgtgattatttgagttaatattgtcttaaggtaatatcatcttgaagacttgtgatttgggttcttgagattcggtgggaaaatgtggaagaatttgataaagttttgattttgacggatgaatttgatggattcttaaatcttgatgttgcaatgtgtgttttatttactgtttgcttagtttggtttcatctttcaactttttgtttcctgcctttttcttttagcagttgttatctttatgagccgagggtctatggaaacggcctctctactccatcggggtaggggtaacgtctacgtacacactaccctccccagaccccgtacctgtgggatttttttgggttgttgttgttgttgttcttatctttacgagaagaagggaaattttgttaataggttctccaacggatcgttctctttaattttatccctttctagtgaaccttatttctctttcttgtaagactaaatgtatatatgtatctatctatctgcagccagatgtgtgaagttctccctttgtgtgcctctccccatcgcatattcctctccgcttggatggtttcctttcagaagggcatgcagagcttgacgactgtggtttcatctttcaagaagtttaggtgggcggttccattaggtcgtggtacatcaaccggtggtagtaagtctttttacccaattattgggtttcttcacctgaaattatgaaatctatgaaatttatcatccggtgatagtaggtcttttctgtagctgggcatactagagagagcttaccatgaatcctaggatatcttcctggatctttcatatttactgcagaacaccaatatgtgatgttttttaaagataagaaacatttattatggctgatactggaatcagtgagttcagtagcaaactgaagtggggtgtacaaacacttctccaatggaccattggacaaatttcagattgtacgagggagctggaagtgacctaagttgctcagcctcgggtgtggttatccgatacaggtgctgctctagaggtcgcctccttcatgatcaaaattttaagattccgggctacaaatatgagttggctaaaaataattcaagtatctaaaagtagagttatgaaaatatgcctaaataaagagacattatgtggaaaacttacatggtactttagagagcaggaaaaagactacatgttcagtaaccatgaagagtgaagaacattaaccttcgtaggaagcaaataagaaaacagaaaagcattttctaactggaacttgtaggccttctacattaccaaaggagaatcggagaaggagataaacggaaaaggattgacatagaaatttcagtatgccaagtattccattttcttcaatttcaccttagcttttatatggaacttaaggaatgcatatgtttgttattgttgtcagttactcgtgcacagaaaaaaaaaagattactagctttatagggtgtttttctggcttgagtggaagatcaatgccacaattcctttgcttatactgtctggagacgaaaagttgcttctttttagactttgaactggtgattttttgtgaaaagttgccctctctagttgtgttgttcattgtcttggtgtgctcgattttgtgtttctgtaactttctttgagatgctgaatattttttctcatgtttctttcagggcctatcgtagtgggttatgacatattgtggttggtttttagtagctttgccttcgcctgcatggacgttaccttcctgagtttagtggttcatccatatttagcgcatgttacaatacttttcatcatagcaattgttgtgatgggtggcggcagtataattcatattgttgtgctgtactctattctgtattggtatcgtgacatgcctttccggttaattggtgccaaggttaaatttatggtcgaggttattcctatgataactgcagcagccttgcatcaccttttggagttcaattataaacatctcgctctactgctgggaagtaccacatatttctatacctatctccacttcttgcacatagcatatgatattagaggggtagatgtattgctgggattaggaatggaggttctagcttacatgttgaacgtagaaatgttagttagagctttggctttgagcttctgtgttggtttatctttctatagatacatgacatattgtgctcctgaattaccttctcatcgtaaaaaggagttggagcaaccgccttgttgatctgaatgtgtccgtagaggactaatatcatgtacttttactggtatttcataaactagtcttagtgtacaaagcgcacctaactcattcaaagatttatttaaaagttatttttgagttataacataaaaatacaagttcttaaaaatagtgagtcttggtcgtatataactaactaaataaaaaataaaactgctccatgaaaatacttaatcagcagtcaaataattcaacttaaaatgtatttcaaagaatgattgaagttagaacgagaacgtatttattttggaagtatcattattcaagtgatattagcatttaaagaaaattctaattagctagctcataccaaattttaagaatttaattgaatttttttttttggtaattaaagacgtttattcataataaaaacacttagaagtcattacaacatgagatttgtctaggccacgcagtgcctattccatctctattaaaagcaaaaatagcaaatacaggcggataatagtacaattctaaattagcaaaagagttcaggctgcatccattcttggctaaggcgtccgctaccccattagcttccttgaatgcatgtctcaacggaggtgatcccgcctcagataataggaacctgcaatcctcaataatattttgataaagcattttcccattattaatcatatttataagttcctggcaatccgtttcaatgactaaaggggttagtctattttggatggctaattgtagaccttgtaataaggccatggcttccatttgaatatttgatgcattagtaaaacccttgctgaagcctagtatccattccccgttgttatccctgaagacccctcctgtgcctcccttacctagacagcctgggcaagatccgtctatgtttaatttgtaggttcctggctctggtggattccattttatgaggattttcttttttggagatctagtagggctccaattactaaggaagaggaattcctgagcaccattaatcactttgcttatggtaggatatgagctatttttgcgaaagactctttcatttcttgtggtccataagtaccaaaggaggaaaggtaagagactgggccaagatacgtattgattaaaactcttatttgattttagttgaagttttagccattggaaaatagtggtgccattgtctaagattgggaaattgtgttttatatgacattgtccccagatttctttagaataagtacactggaagagtatgtgctttacgtcctcctccccttttccacatatggtgcatatatttgtagtgcaaatgttgcgcttagctaggaaggaggctgtaggaagtctattaagggtaagtagccacatgaagtacttaagtttattaagagtgttacttttccagatccacctgtagtcgaggttgttatcatcagtagtagtgtcctggagggaaataaggtcatatgctgctttgattgagaaatagttatgacctggcgagctccaggatattttgtccatgccaggcagggactgttgtatataggtgctatggattttttagattatttcttgaggaaattcgaaggatagattgaaagacccatgcttgatgattgagctgactgtcatgtcttcttcccctttttggagaggaccctggatatattttcttaagatgtttccttggttaatccagcggtcgttccaaagatctatgttgtctccattaccaatagtccagaagatccctccctggcagttccttattccattgtggatatttttccagatatgggaggatcccggcttaggggctagtctgttactgtgagtggcagccctatcatatttattgtgcagcatcttcacccaaagggcttactctaccccacgctcagttccagcgtgcaagtcacctcaatatagcattacaatgcgaaagtccagggtttcaaaccctcagaacaacatttactagcattactcacctctagtcggccggaaaactagtccgagatgccttttcccttcaaattcttctctacgagcgccgaatctggctaaaatcacaacgaatatgctacataaggttaatggaacataacccaatcgaaatatctcgaaaaatattgaaattcgcgaaaatgacaaaacccgagccccgggcccacatctcgaaatccaaaaatttttacatcacaatgaccctcgtctcgccacgagtctatacatataatttcatccaaatcggggtccatttgacccctcaaatcatcattttcatacaaaaattccaagccctagttcttaacatttttaccctattttcagtgatttgaaacttgattctatgataaaaacacgtaataatgacgtgatacttacctccaatgacttcccggtgaaacccccttcaattcccgtcaagaagctctcaatgtaactcacaaatggtgaaaataactatgaactcgcggacaaggacttaacttaaagtcttctgtccaggcacgcttccttctatgcgatcgcggaccatcccctgtgatcgcatagagtaaatcctgaagtcccaaaatttgccttatgcgatcgcactatatggcctgcgatcgcactgcttcagctgctcgagctacgcgatcgcggataacactctgcgatcgcagagaaaccaaacacgcctctacgcgatcgcacaccagactttgcgatcgcactgaacaaccatcaggccccttctcagcccctctatgcgatcgcatcttgctctatgcgatcgcatagagcaaaatcgtctgcaacacctgggcagttttctgctgcatttttgaaccggaaactagtccgttaaccacccgaaatcatcccgaggcccccgggacctcaaccaaaaatacaaactcaacctactacctcattcaaacttgctcgggccataaaaacactatcgtaaacatcaaaaatcacaaaaaatccacaaaattcaatttcaaactaactttaacttctataaatctcatccgatcaaaaacccgacttaacgatgtccgaattacctgaaaatttgcacacaagtccgaaatcacctaacggagctaatgcaactgtcggaatttcattctgaccctcggatcaaattttcacctatcaaccggattcttccaaaattccaacttcggcaaacttagctaactttcacaccggacctccgaattcaattccgttttctctcctaagtcataaatcacccccggaactagtcgagcgatcgaaaatacgttccaagccttctaactcataagtcaacgttgggttgacttttccaacttaagcttttcttaaagagactatttgtctcatttctatccagtttcccttcaaaccacttcaaactcacccaacacgtatattagcacacggggaaatatattacgggggtaacggggctgaaatacagtaaatgacgggtcgggtcattacagaaatttaggagggcagcgactatacaacagaaggaaaagtaattataactaagccaccatatgtctttaagccttacatgaccccctgaaataaacacgagaagaacatattcatctcaaagaaagttatgaaaacacaaaatcaagcacaccaagaccatgaacaagcacaattggagagggtagcttgcaataaaaaccaccacttttaaagtctaaaaagaagtaacttctcgtctccaaactatatcagcaaagaagtcgtggcattgttctgccatccaagctagaaaaacactataattatatccgctcccacgaatattcataaatttatggcaatatcaatgataagattttgacacactgactacattgtccaacttattacattgtgtatacattcattaagttcagcttctttctgacatatgaaatttgtccaatagtccactagtctaaaagtgtttgtacaccctactttagttgattccagtatcaagcatcatatacaaatggattccatctcaaaaagcaccagaaaattactgttatgtaccaaatttgaaagattctaggaatattcatggtacgtccactaccccgttagggatagacttgatacttattaagtacacgtgaattatcatatgttcgtatgtgacagatttctaggattaaaccacataatttcaagtcaagaaacacaatctttaggtgaaaagacttaccatctgatttaccgccaaatgcttctggaagcctaatcttcttgtaaattaaaaccacgatattcaagctctgcgtgcccatctgatagcgaaccgtcgcattgccacacggagaggcacatagagggatagcatcacccatgtggctgcagatagatttcatgtattgatttatattttgctgtcttacaagaaagggataaaattaaggagaatgatatgttgaagaagctgttttttcactaacagctgtaaaaagagaaatcccagtgtattcccacaagtcgaatctggggaaggtaggatgtacgctaccttacccctaccctggaagggtagagagctatttccggaaaaccgatgtaagaagcagcaatagcaagaaataacaatacaagaaaactaaatccaagataacaaaggagaattaaaaaagaaaatatgcatatggcaatttggcaaaagaagttgaatataaggggctagctagcaacatcaacaatatacaacaaattcataattagtaggccagagatatcaaatgatcataaaatattcacaaaataagacagatttattaacttcataacactaccttaaacactagtaaagacttaaaaaaaagaagctaatacccatataataaatttaatttgcagaaacgttactgattagattagctaaaaaacttcaaagggtcatcagaaaacacaaccaatcataccactttcgaatatttatttttttaatagaaattaaaccatgttaaacaaattgcaaaaacctgcaggaaccaaaggttggatttttgttttaaacttttatctgttcttttagggtttaaagactgaaaatttgcttatggtggagggggataaacaactgtgtagaagtagtattagagaaaaactgcaaaaggtctgaaaactcaaaaattataactaatttatttatttttacaaaataataataatagattaaattcaactaccttgacgaaaaagatcccaattgtgctgcggccttcaacaggagaagagaaagaacgagaatgagggttaaggggaaggagttatattcctgccaaagaaaggaacgagaaatagaaaaatagaaaaaaaaaattaaaaagttttgcttggcgtttttactatttatagtacgataatataatatgatggcatgagtcacttatggtaatagccataattaagcggtaacttttttatttaattagtagtcattcgttttcattgccgggtaagaatagccataattaacgtgtagtaataatttttattttgtagccattcctttcattgcccggagtaggaaactaggaatagccatagttaacgtgtaatttttttttttttttttttttnnnnnnnnnnttttttgtagtcattcctttcattgcccgactaggaatagccatatataagcccaaattgacgtgtaatttttttttttttggtagtcattcctttcattgcccgggtaggaatagccataatagcccaaattaacgtgtaatttttattttgtagtcactcctttcattgctcgggcaggaatattatgtattttttgcttaattaaaagcgtatggtatgtctataaataaacctattctgagaaaaggaaaaaaatattaagacaaacacacattatttctcttcaagtctcattttgttatcgcatttttagcaagatgaatcttgaacagaagatgtggcatgctctctttttgcttgcttatgttatttccgcgatacttttggttggaaaagctagagtgggttgctgcactataggtggtctcttgctttttccagtaattctactgttactctctcaagaactacaaaaaaagtatgttgatatcgtcaagtcaagaagtacagttattgtgtctaaatatgctcgtgcatgcaacaatgttggaccatttttgggactgtggatgggaatgatagtaaacagccaagaatccattggcctattaatacatatgtttcttcttggttcaactgtttctgtggttttcatgctcatgctaattaagccagtgactagtgactttgggatttttaacttgctgtctgccgttactgttggcctttctttgagggattataagtgtggatggcagacaaggctggcagcaattatttgtagcattctaatggtcaggggcggctcaataagtttggtaacctaaagctaaatttaatgtgaggctctttaaaaaaaaattatatatatttttagttgaagtagatttttctagcttttttggaataaattacttcaatttttttgcataaaccatttaaatagagtttaaaagtgtattacatattttctaatgattaatgtaattctttttttaaccataaaatattacttttctactttgaaatacttaatattatcttataaagatttgggaccgcacgagaagagttgtggtggaatggatagcatatctcattcgttaaacgaaagtattcggtttcggttttggaatgaaaaaaaaacctcggtttcagttttggaatgaaaaaaaaaaccttataaggaagggttcccattttaatggactttacacggtatgaatttgaattaattaatacctcaaattaaatatctgacatcaaataagaattggaaaacaaaaattggggcccctaaaattctggggcctaaagccaccggtggttttaccttctggcagcccttgcacctgtgtatgacttccaacatattatgctggaactccaacatgcagaaagttccagcataatatatactagagattggagcacctgtatatgaacttccagcatattatactggaccggtatattatactcagtggcaaagccagaaatctattcaagggcattcaaaattgaaagaagtaaaaaaatattccgacaaagagtgatcaatatatgatatatacctctaaaatctaatattttacctagtacacagtataattttctgactaagggtggtcagtgaccacccttcaaaacatatagcttcgcccctgattatactggaacttcagtatattatgatggagttctactatattatattggagtattttccggattttgaacagtattttcattcagatttatctttacatgaaaagtagctaaatttcgattacttttgaaactatggctatttttgaatgaccacttataaatctggccattttttaatttctctcaatttttttcatactcaggattcaaacccaagacctctgtctaaaggtaaaaggatattatccattccaccataacctatgttggcattttgataacattttaccaattcattttggagttggtgattcatattatcaaacaaaataaactgaataatacaagaattcaactagtgaaaaaaaaacataaaagtatttaactaagttgtctaaacttaagtatattttaaatacagattagaaccaaaaaaagactttttaaaaacccgacccggctcacttaaggcccatatgttcgtgatctaggatcggatttatcaattattattgtttaaatagcacggtctaactagttttcggactagtcattgaaaataaccaacgtttgccaagtcattgaaaaattgccattattttgctgtaacagatactggtccagcataatatactggagttcggtacacctgtgtatgaacttccagcatattatgctggatcattatagtttgctagctccagtataatatactggagactggatcaccggtgctccaaactccagtatattatgttggaccgctataatatactggagttccagtataatatactagaactccggtatattatgctggaatatttttttggattttgaacagtgttttcgttcaaatttatttttacatgaaaatgactaaatttcaattacttttaaaactgtgactattttagaatgactatttataagtccggctattttgaacttctcccattattattacatattagtaaaaattatgtggggtagccactttttaaagtgatatttactttttatccagcatttttaatgcttagcaatagtagccactagtctattaaaattaatataaaaagactgtgttaccctttcttctatctctttcatgttagggaaaatctcttagttatcacagctccatcttgatatacgcaaacagcttaaataacgacaccaactgcaatgctcgttgcctttacacctctaaatagcatcactaatcccactgtgaatctgtacgatttgaaataaaaagagaaacaaaaggaaaaaagcaaaagttagtgcaaaccttattgaatgactggaatttgagttattattgcagtgaaatcagatacaagcaagcagtgaatttgccaataaagatttctaatcggcagaaacatatacgcattgaaatatcgtctatttggttttgggtctgtcaaaccattgacaaagagttcaattacttgcatggtagtactgttactacactatacactttcccatttacaacaattcacttttcttattatcaacccaagtggaaaaacggttgtaatgagttttaagggctgctttgatgtgcaacacagcaattctctttttccaaacaagctaaattaccatataccaaaccaacaaaaacaagctcaaaagttaaggacaataggtcttcaacttatagttacaagttcaaaagttaaggataataggtcattaacttacagttacaagttcaagtccttaactttgatttccaagttcaaaagttaaggacatacagtccttaacttacagttacacattcaaaagttaaggacaagcagtctttaatttatagttacaagttcaaaagttaaggacatattgtccttaactttgacttacaagttcaaaagttaaggacagagagtccttaacatacagttacacgttcaaaagttaaggataagcaagttcaaaagttaaggataataggtccttaactttgacttacaagttaaggacgcttggtcttgaagtttgagttcgaagttcaaaagttaaggacacgtaaccttgaagtcctgaacttagaattccaagttcaaaagttaaggacttgtagtcctgaagtcctgaacttagagttacaggttaaaaagttaaggacatgtagtcttgaagtcctaaacttatagtttcatgttcaaaagttaaggacatgtagtcctgaagtcctgaagttaaggacatgagcaaaagggtattttcgtccgggcagttaaagtttattaaactagcggctaaagacatttaaaacactagctttaaaataaagacatgagctgttagtggctatttgtgcacatcgccctcactttgggcatagcccaaatcagcacaaccagcaaaatacatattgcccaacccattaagatttggacgggttgagcgggtcaaatgggtttgggctgattttgccacccctactgtctagtaaaggattgaaggtgtggcatagacgagcaaaaaaatggagtaggcttattttactcgtgatgaaaggggaatgatcacaagcaagaagaaatatatcaccaaacttttatacatataaatagctagatagattgtttttatgcattagcctaaggtgtagtctgacaataatgtcacattatataatatgacattcttctttcataaaaccaacgttgtagcttcacttgaatgaaatccatcattcttagtatgggcagctcccttgcatctaataggacagaattcattgactcgactatgtttgttgtgagcatgtcatatcttcgtcgtggactacaagaacgtgcccatctttctggtggttcttccatcaagtagtcatatgtcttctgatctacattagcaatatctgacatgtatagatcaaaatctttgcgcctgtatactcttgcagcactttggaaaagttttatctcctcacttttcaccttccttcgctttaggttctgctccaaatgatagatgcaaatcccatgatggctttcaggatatacctttgcaatgccatttgcaataacttgatgcatgtctgataaaaagatcaaattctcgcggctcccaattgcattgcgaagctgactaaagtaccactcataggagttgttgttttcagattcagctattccaaaggctaatgggaaaatttggttatttgcatcttttgaaactgaaatcattaaaacaccacgatattttaacttcaaaaaagttgcatcaacagcaatcactggtctacaatgattccaactagctattgatgatccatatgcataaaacatataaacaaacctgtaaatttaatataaaaaaaatattaaaatacatgaactttaggacagtcagtccttaacttatatttagaagtaataaagttaaggacatgctgtccttaacttttatttcaaagttcaaaacttaaggactgaaggtccttaacttttaattacaagttcaaaacttaaggataggcagtcctcaacttctggtaacaactgaaaagttaacaagattaaaatacagcatgttctaaattgtttacctgttgttgtcgtctacctttatgttagtataggttcccgggttgttacttgttatcatatacaagtatgaacacaataattcataattttcttcggggcttcctcttattaaagcggaagcatgctaaatagcacgccacgccttgtgatatccaatgtctagtccatgcaatttttgcatctctgccatgacaaaagctggtgtaacttcaaatcttgggtcccgaagattgtcgataatgtaaccactaatcaactttgaagtagcatgcctttgatctgctttcctagtgttaacagagcagtcatgctttttctcaatctttactatcttgaacaatgttgaatcttttattctgaaagcacgcacacaccaacaacacctatcatcattgcatgtcaaagaatatcttgttgagcttgatcttacaaccttgaattcaaaatgtcctttgattgctatattggaaaaacagttaattatactcttcttcttgtcaaatactgatccgacttttatttcatccaatgaagcattttctcttaatatcgtagttggggattctttttgtttcaattttgatattcgtctagttatttgtggacaagtttgttcagcaacttcttcaattaatggtgcactctgtaacacttgaatacccaaagcttgctcgttgtcaatctcaataatgctttgtccttctacgtgaacagattcaaatgtttgaagcacctcttcatttaatggttgagcttacaccatatctatttcaactatctgttgggattgctcttgattgtcattttcagtttctgtattgacatattcattgcttgttgatgaaaaaactctttccgcaatatcaactatgaaacgacatcccttgaagagtgaatgagtttttagcaattctatacatgtgcgaagatctaaatctttggatacaagcattcctttgcttgttccaaggttgatatcaaaccatattactaattcaaacttttctctatccaattcaataagctcaaaaatttatttaatgaaatcttcaaaacgaattgagtcaggtgctatgaaaagctttgtttgatgatcaagatattaatagtcttcagtccatctaccattaaaagcaactattatacatattgttttcatcctgtgatgtggggtgattttaccacatcttttagcctttttaccttagctttgttgtcgttttaagtatgaaatgaggacatttatagtggttattgtgagattttcaggtacatgttgctattgggtgtttgggatgaaattgaagtgttttgaagagaattgaagtgaaaatgactgctgggcaaattacctctacgcgatcgcagagatccacctgcgatcgcagaagttcagtcaagccttatacgcgatcgcaggagactgcacgcgttcgcagaagcttcagaccaattatcccacgcgatcgcagacatgctcacgcgatcgcagagcctgtacaacctagacctacgcgatcgcagggtgtctcacgcgatcgcagaagattaagcatttactctacgcgatcgcaggactgttccacgcgatcgcgatgcttcgtacctgacactgttctgggcagtttcgacatttcacattcttttaccccaaatcaagtatatactcgtccaagcagacttttgtagagatctttggcaaatctaaatcatcttcttacaattttggcttagagaacaagtgtggaaactagggttcttgcacaaacacacttgggttgtgttgatttcaagcttttggttgaggttttcttctccatttatgtttgtatcttcagttccttgctttgtattgtacatctaagtgtgtagtattttatccaacacttgaatcttgtttatggaaatattcataattaaagtgtggattttatatcttgttgtgcttatgtattgattgattttattttatttatgaagtgagttattatttctttaattaatcttgttcttgaatgtttccaaagggaatagctaaccctaggactcgcccattaattccgaattgattttgggaaaaatagtttggttttgggaaagattaattaacaagaacttgaggatttaaccctcattttatagattcaacctaggaataggattgaactacttgtagcctatcgggtgtgcttaatcttctaattgtgattagggataattcaattaggaagtcttgttagtcttcggaagaagctaattgagaattattatccgtggctaattaacataaattcgctcatatttgtgaagtcatgaaatatattggatcgttacttgtgtgtaattcccgatgcattcatacttgtagccattgatcattttacttgctttctaggttagttttagatatagaaatattttcacgcattattcttatcgtttggcactgcgcgattagcgataattctcttacattcctaatcgcctacacattgttctctgtgggatcgaccccgactcatagttgggtaaattatattgcgatcgaccgtacctattgctttagagcagtggatttggacgacatcaattttggcgccgttgccggggaacaatttggcgtaatttaggttgtttgagaaataagcgaaagtgctttgatccaaacttgttaatatttgtgtaattaattttcttaccttgggtctagttttattgttagcttcttatttacattttttttattcttgaaaaatggcatcatataacgatagttggtcggatgagaattattcatattttgacgatccatgtccttattgtggtggaccacactcatggcaaaattgtttaaattcacccgggggtggattgtgcgcacaatctcaacctcatgggtggaatatttgtgataattgtggttgccaaaatggtcattgggattattgtgcatatttgtccttcccttccccaagcccctactatgatgagtttgcttcttgtgatgaaaactatagggctatgggatttgaagaagttgagcatggcaaaaacggagagttcaaactcatgttggagtgtctacttgaagaaggaaacaaggaacaaaatgccttggaaaatcttttggagactagtctccaaaatgacttggcacttgaacggttgcactcgcaaatggatgatttgatcgaaacctcaagggctcaaaaagcctcggaagtgaatgaaaaccaagaatttatcttggagtttgaaaatgaaaatccgtccttgacacttaatcaaaaccaagaagaactcccaaatgctcaaaatgagaaaataatgctcatgttggagaccattcttgaaaatgaggagaagcacaacttggcactcgaggacttgaaacaaagcttggcatacaatgataaacacatccacaccttggaaaatcaaatgcaaattttggttgaggctcactatgcccaacaacttgagtgtgtggaagagagacaagaagagtccaatttcgagaaagaaagtgagctttgctttgaggagtcaagaattgagcatccgccaaccgactcaatgtgtgttatggatgccgacaaaaatatggaattggagtcaaccggtaaaaatgcagtattggttgatgttgactctaatccgggggaaaaggaggatgtcaagttagaaaaattgcaaagtgaaggcttgagatcacattccaaacatttttcaacgttagaattgtgtggtgacacggaagttgaaccacatgaatcaatgaagaagtgcgaggaggaaaagctcatgccatacattttacagtttgaggagaaaagaaatcaaaatggcattcctcacttgcgagccaagaagtgcaaaatgaagaatttaagcatcggctcgaacatcaaattaccaccccccatcgctcgtggtcacaagcttgattccaagctaggtgcccagttcatatcatcgaagtggcgcgaaaagtggtaatgttgtttacgtcgtgccacgacgttaaatgcggcgcttggtgggaggcaacccatcggtttttcaaaatttttcaccgtttttgaaattttatttttttgaaatatcttagaatattattttgtactaatctgccaagtttcagattttttggaagtgatttgagcatatcgggatgtccgggcagccaaaatccagtagctgctgaaaactgccagaaattgcagtgctacgcgatcgcataaaacctcacgcgatcgcgatgagtcagctaatgctaactctacgcgatcgcagagatttccacgcgatcgcgtgagttgtggttaaatggtcactgcgatcgcagtaatacctacgcgatcgcgtaggtctgcgtgaacttcagatcttaaaagccttgggggaattccaaacaccccatttttaatcaaaacagagaagaaacggacccctgcccctattttcctttgtaaaaataccaccaagagatcaattagagttaaattcctctgccttcatcttgcatcatctctaaggtatgtcattctactaccctaaaccttggttttattgcatttctatggtaagtaatggttaggggctgccctattttcagtggtagggtttcaaattttgatggtttgaaatgccattgttgggtttctttgtgtgcttgcttgttgtgagtgattggttgagagaaaagagagttttaggttgaaaattttggggcaataatatatgtaattgtggtgtataatggctgtaaaccatggtgctcaccacttgttcaatgaaatgcctcaaaggcactgggtctggtcgaagaagacgacccacgcgatcgtgtcccgttgtctgcgatcgcgtaggtctaagattaactgtgcaaattttttgttaatcgcgatcgcgtcgtcctgtatgcgatcgcgttgcttggcctgaagatcttctctgcgatcgcgtgattgcctctgcgatcgcgtaggttgcagccagcttcttctctgcgatcgcaggccagtctatgcgatcgcgattcaatgtagcccagtgcgaaaaacagaaacttcgcagattctgccccgatcgctctctaacatgtttctttggcctaattaactctaaatgcaatgctgaaagtcgccagatggttgtttgacatgaatactttgtgtgtaggaattttgagctattaaatggatccggcaatggaagcaaatgtgcaacaatatgccgatcaagttgcagctgaggaagattttgatgctgctatcttctcctcacgcagatgctcagatcgatatgacaaacaactatccaagaatttgataagggaaagaggcatacaactggccgacctggaggatcgatggcctgacttttatgggaaattgcttactagcggctggatatgctttgccgaagagcccaggccagccaactacgaggtcgtccgtgaattttacgccaatgctgtagaaacggacttcaacaacgaattggtggccacggtcagaggttgcacagtccacttcagtccagagcggattaatgctctttacaaccttgccaatgttgacaatcagagttacaaagacaaagcgcaagagttgggcaaccaatggttcgtcacccacttgcacgagggaaatgtgccgaagtggataaaaaatcacacaaggatcgagtcttcggaattcactacggaggccaaaacatggctctctatcatatgtgctcgcatcatgccttcgaagaatgaaacagaagtgactcctgaaaaggcaaaggtgatttgtgcgattatagaaggtttgcctgtgaatgtggggcgactgattgttgacgagatagcagaagtggtagcggagcggactaagagtttatttttcccatcactgatcactaggctatgctatgaggctggagtgcagcctaagcctatagaaaatgagaggcaaccagaaaagcttgttcatcctttattgaggtacaaggcaggagcggcatcaaagaagagacggattgacgtagattcctccagctttggccagttcccacagacagagattcaggatgctccttcagatgctcctgcagatgcctccagtactcccacagcgccacttgaggagggacctctcacactcaggtatatctctcgacaggtttatggcatggactcacatgtacgacagcttgtagctggtcttcctttaggaccatccggagagagtacttctgcaggtgcttctggctcagagaatgctcccactttggctagtgtggtgaaggaacaaaaagcaatgaaaattaaattagaggagattagccggaatcaaggaaaaattgaaagaagacagaagaagcatagggagtatgagaagaaaaagagcaaattcctcaataaaatcttgaccactttgcacaaattctgtggagcgggtgagagcgtggatgatgacttcgagcttgagccgcctagctcctccagtggagagtgatactacccagggagcacctccttattttggcttagattgcatacttgcattggggacaatgcaatgttttcggttgggggtggcttctatgtttttatatttatgtgatgattatgtgggaattttttttgtttgttctatttggtggttgtttttggatgatattaaacttgaacttgtgtagatttataatgttattatattagtaaatccttgttagtttctatttttcttgttgaatattttcttcttagtagtagtagcttcttttattttagtagcttcttttattttcatttgtagtagttttcttttattttattttcatttctttaaataaaatttccttggattttcttcatgccacggttctttcccatggaacacttttgattgaaccgggtaattgtaaaaagtttttggtgacttttcccgatgatagatggattgacaactttcttaagggaattagtcttgttttgctaggatgaggcttttggattatttggtgctaatgatattagcctcttgtatgtaagttgtgaattgagaatacccctccaaaaatttggtttgaattgaaacaagttgcatggtgcaaatttgatcttgtgatacgattttgactcttttagtgactctttttgctcattagtttgatattgcgcttcgcacttttattagaaaacaaaaatatctccatcttgattagttcatgtgccatgtgtgttagtgtttgtttaaataaatcttgtgtttacttctatcatctagaacttgcccggttggtttttcttgctaatgacactttgattggatggaggaatgatcttaggcattctttgcttttatttgtaaatctttctttaacctttcaagcctacccttgtgcaaataacatcactagtgtccaaatttgagccgtaaaaccttttctttggccaactcattacaaacctttccccgtttgaaaaataattccctcttttgaacccgtcccttcttgaacattgagaatgaggctaaaagcctaagttgggggtgtaatcgaagagaagtagtagcaaggttgtacatagagttgaggaccgcatgcctaaaaagtatttgtttaagatattcaagctccataaaaaaaaaaaaaagagaaaatatgtgtatatatataaaatatggagtcttgaataaaattagaagaggtgtgtgaggtggtcctatattgggaactagttgaaaatgaagctatgggggtttaaaaagaagcgaagtgcaaaagaatgaaaagagtgtgagtagtgttcaaggagggtgaagtcacttgtacctaaatgtctatcctacccgcccctaaacctacattacaagctcaaaaagtccttatgagacctccaaccgatcaattgttaataagcgatgaattaaaataagggcaagcctatggtatgaaatgttgtaacacttgaagttctttgtgagagtgagtgttcttgaaaaattgtcccttgtgttgtattgtaaatattgtgagtttttggaacttttctatttgttgtgagggcacatgaattaggaaagcttggtaaaatttgagtaaagtgagcgtttttaacaaactagtgcttttgagtcacttcttgaggcttacgttgatcacttgattacttttgacatcttttgcacaattttaaaaattatttttccttatgagggagtattcggaaaagatgcatacttgagcctaactgttagtaccaaccaagtccattagtaaggtgtttaaatgggagaatgtgttatgtaaataatggcaaagccacttgtgtttgaaatggtgaatcctcatttttggttttgatttacttgaggacaagcaaaagctttaagttgggggtgttgatgtggggtgattttaccacatcttttagcctttttaccttagctttgttgtcgttttaagtatgaaatgaggacatttatagtggttattgtgagattttcaggtacatgttgctattgggtgtttgggatgaaattgaagtgttttgaagagaattgaagtgaaaatgactgctgggcaaattacctctacgcgatcgcagagatccacctgcgatcgcagaagttcagtcaagccttatacgcgatcgcaggagactgcacgcgttcgcagaagcttcagaccaattatcccacgcgatcgcagacatgctcacgcgatcgcagatcctgtacaacctagacctacgcgatcgcagggtgtctcacgcgatcgcagaagattaagcatttactctacgcgatcgcaggactgttccacgcgatcgcgatgctttgtacctgacactgttctgggcagtttcgacatttcacattcttttaccccaaatcaagtatatactcgtccaagcagacttttgtagagatctttggcaaatctaaatcatcttcttacaattttggcttagagaacaagtgtggaaactagggttcttgcacaaacacacttgggttgtgttgatttcaagcttttggttgaggtttccttctccatttatgtttgtatcttcagttccttgctttgtattgtacatctaagtgtgtagtattttatccaacacttgaatcttgtttatggaaatattcataattaaagtgtggattttatatcttgttgtgcttatgtattgattgattttattttatttatgaagtgagttattatttctttaattaatcttgttcttgaatgtttccaaagggaatagctaaccctaggactcgtccattaattccgaattgattttgggaaaaatagtttggttttgggaaagattaattaacaagaacttgaggatttaaccctcattttatagattcaacctaggaataggattgaactacttgtagcctatcgggtgtgcttaatcttctaattgtgattagggataattcaattaggaagtcttgttagtcttcggaagaagctaattgagaattattatccgtggctaattaatataaactcgctcatatttgtgaagtcatgaagtatgttggatcgttacttgtgtgtaattcccgatgcgttcatacttgtagccattgatcattttacttgctttctaggttagttttagatatagaaatattttcacgaatcattcttatcgtttggcactgtgcgattagcgataattctcttacattcctaatcgcctacacattgttctctgtgggatcgaccccgactcatagttgggtaaattatattgcgatcgaccgtacctattgctttagagcagtggatttggacgacatcatcctgcaagtcaagaaaatgggaaacagagaacatctaagaacaggtgtactgtaagtgcaagtccaaggtaaggactgcccgtccttaacatttagtaatggaattaaaagttaaggactaccagtccttaacatttaaacattgaattaaaagttaatgactaacagtccttgacatttaaccatggaattaaaacttaaggactgccagtccttaacttttaaaccagaaattaaaacttaaggactgaaagtccttaactttttaattccaagttataatgtttaagggcgggcagtccttatcttttaatttctggtttaaaagttaaggactaccagtccttaacatttaaacatagaattaaaattcaaggactaccagtctttgacatttaaccatggaattaaaacttaaggacttctagtccttaacttttgaaccagaaattaaaacgtaaggactgaaagtccttaactttttaattccaagttttaatgtttaaggacgggcagtccttagcttttaatttctggttcaaaagttaaggactgacagtccttaacttttgaaccagaaatgaaaacatacaatttgaaactaaagctacagaattttgtatacagaagaacagcaacaatgtccttaagttttttaaatgatattgcaaaatgagggcagtagaatcaaagttaaggacattgcgttcttaatttttgaattcaatttccaaaatgaagacactatgtccagaatacagaattataataggaggcgatgtcctaaactttataaatccagaaattcaaagttaaggacaaattcttgtctattgtataatcaaatcaacacagatctaaaaaaatataacaatagcgaaataaaaatctatagaaacacaataaagtagaacttactgtttatctatgtcgtttttttggattagagtgctgaatttttgaaattggaagagaaattgttggtcgccacagtagatcgccttagttgatcgccgtttctgcagctgctgctgttcgctttttttgtttgtttaactgctgctggtggttatagacgcgtaggtataagttatactataaggggtcgtttggtatggggtataagtaaaaataacaccggtataaaaatttaataccagtttataccttgtttggttactaaatttggtataagttatcccggtattaaaattaataccgggataacttatacctctcatgaggtgggattaataatgatgggattattatcacccaacaaaatatggaaattgaccaaaatagccctatcatttgtctgctttgatgtctttaaaaattgttttacaatatgacctcttcttttactgctcctctgcaataaatttgacgtctcagctaatatatatatatatatatatatatatatatatatatagatacgatgttaagatttctcctctactgctaccaactatcagttctgccttcacttgaaaatgatagaactttctgttttaacttaaaaaatagtacagtttctgcgttggtggtaggtgcaaattcacgtacataaaggagtaagaagatggagggtatttttgtaaacaaacagtttcttcttaaaaattatgcaatgcatatcatttttaatacaacataccaaacagtggatacaaaataataccagcataactaatcccagtgtaactaatcccagcataacttatcccagcgtaacttatcccagtacaaggggtattcaaaccaaacgacccctaagggtattattgtccaatcaagtataagtttattaaaggagtggctaatatctaaatacattcaaaacagtggctttaaaataaaagccactgcttttagtggctatttgtgccgttcgccctacatattacaatcggtccagcccaacaccttaagaaaggatgcaagcccaatgggccgaggagatgtgggccaatctctgatcagccggcccatttttcaggagttttaatccccactttatagactttgttgcctgttttaattgggggatttgcagccgtacccgttttttgtgtcacattttaacttgtgcccgctttgtccttttgtttgtaagcgtacccgctttttcaacacacttcaactgttaggccgaagtgtaaaataaacacttaggctgttaggcttaagttgtccagttataaaataaacacttaggcagttaggccgaagtgtaaaataaacacttaggctgttaggcttaagttgtccagttataaaataaacacttaggctgttaagccgaagtgtaaaataaacacttaggctgttaggcttaagttgtccagttataaaataaacacttaggctgttaggcttaagtcatccaattataaaataaacacttaggctgttaagcttaagttgttcaggcttaagttgtccagttataaaataaacacttcagccccgtcggctgaagttatgtgaaaaagtgggtacggatgcaaacaaaaagataaagcggctataggttaaaagggggcgcccaaatagggcgccccgtgcaatttttacgttttaatttctctttacagagtggtatttgtatttaaagtataaatcatcttctcctttatacttccttcgatccataataagttattttttgacttttttttgtggtccaaaataagtgatttttccagatttcaaaaatgaattaattattttttttctacattgtccttggagtaaataatgttggagtatgtattataagtgtttatgtgaagagatagtaaaagttaatatggtcaattttattactaattaatgttaaaaggtaaatttcttaatatatgtgaatacaatcaaaaaattacttattttgggtcggagggagtactttatactaatgataaaagtcaataatacagtaataatgtcacgacccagattttccacccttcgtgctttatcactcttcctcacccaaacaaaagtcacaaataaggggaacgaacaaatagtggtagaaatcccgggaagggaatataattaaacagttaaagtccggcaaggaaacaatatcaataaattcaatatccccgcaagggagaaaatcaacaaatcaataaaacatcccggcaagggagtaatcaataactctttctctttctttcatttcttactttagaattcactttatcactggagtcaacgttccaaagaatccaattatctcatataccttcacaattcgtatcacaactcgagccaatgctcctcgaagtttaataatcacaaattctttcacatgctcttcacaacatataaaaatcatcaaataagcatgaagttacaacaaaatcagaataatcgcaatataaagactcacggtcatgctagacaacaatgtatagataatcgtcaccatgcctatacatcgtactcgacaattagcaagtagcaaacaagactctacacctattccctcaagctaaggttagaccaaacacttacctcaacttccacggccaaatcaatccacaacaaccgctttccctctcgaattcggctccaactcaatcaaatctatacaataatgattccatagtatcaatatatgctaaacaaatcaaccccaatgcctaaatatagattttcaagctttcttcccaaaatttcaaaaatcgaccccgggcccgcttggtcaaaacacgaggttcagaccaaattcatatcatccattccccacgagcccgaatatataatttattttcaaattcgaccctaaaacgaggtccaaatcaagaaaaagtaaaaagccctaactctacccaattcccccaatttctaccccaaattacatgtttttttcttcaaacttcataaattttcaaatttggagttttaaatccgaacacatcaaacgccgtccgattttaaccaaactttacagaaatatcttaaaccacatatatgacctgtaccgggcgccgaaatcaaaatacaggccccataccaacacattctaatcaattctcactttaattttccttaataatttcagaaaaataatttcttttaaaaaaattcatttttcgggctcgagacctcgactttcaatttcgggcatacgtccgagtcccatatttttctacggtccttccgggaccgtcaaatcactgatccgggtccgtttacccaaaatattgactgaagttaaatttattcctttaataccaaattttagcattttcacagaatttcacatttaagcttttcggctacgcgctcggactgcgcacacaaatccaggcgactaaaaatgaggttctccacctctaaaacagtcattcgtcctcgaacggacagaagaaagaagtacctgactcggggaatagatgaggataacggctccgtatatcagactcggacttccaggtcgatgcctcgggaggctgacctctccactgaatacgcacagagggaaaactcctcgacctcaactgacgaacctgccggtctagaatagccatcggctcctcctcataagatagatccttgtccaactggatagtgttgaaatctaacacgtgggatgaatcgtcgtgatacttccggagcatagacacatgaaacactggatgcacggcaaataagctaggcggcaaagcaagtctataagccacctcccctactcgatcgagaatctcaaatggaccaataaacctagggctaagcttgcccttctccccgaacctcatcgcgcctttcataggcgacactcggagcaatacccgctcaccaaccataaaaatcacatctcgaaccttgcggtctgcataacttttttgcctggaatgagccgtacgaagtctatcctcattaatcctgaccttgtccaaggcctcctaaaccagatccctacccaataaccgagcctcccccggctcaaaccatccaaccgggactgacatcgcctaccatacaacgcctcataaggggccatctgaatactcgactggtagctgttgttgtagacaaactctgctaaaggaaaaaattggtcccacgagcctccaaaatcaataacacaagctcggagcatatcctctaaaatctgaatagtccgctcggactgaccgtccgtctgaggatgaaatgctgtactcaactccacttgagtgaccaactctcgctgaactgctctccagaaatgcaaggtaaactgcgtaccccggttcgaaatgatagataccggcacaccatgaagatgaacaatctcccggatatatatatctcagctaacctctcggatgaataggaaattgaaacaggaatgaaatacgctgacttggtcatcctatcaataatgacccaaactgcatcgaacttcttccgggtcaacggaagtccagtaacgaaatccatggtaatcctctcccacttccacttgggaagctcaatcctatgaaacaatctaccaggcctacttaacctgctgacagttcaaacatcgagccacatatgcaacaatatctttcttcattctacgccgccaataatgttgccgcaaatcttgatacatctttgcgccgcccggatgaatagaataccgggagctatgggcctccgctaagatcaaatctcgaatcccatcaacattgggcacacaaactcgcccctataatctcaaaacaccatcattgtcacgccccaaaatcgagggatgtgaccggcgctcgaccaagtatcctcagtcaagcggacctaggtgcctttccagtcccacgtgttaccccgcttattcattacttataagccaagtgaaatagccatttataattgaaacactttttacaaacatacataacatacgtgatccttaacgttgtttacaacttacatcgcccaaacatacgaaatacatatttacatagactcataacccacatctttctgtctacggagcctctaaagatgaaaaaggaataatatagtacttgccggtaacaaggctccggctataccttatacaaatatcaaaacaaagtcctgaaacaaaaacgacacgagccatgaaggaccccgaatgaaaaagggctcaccaactcaactgataggaagtgatgaggagctatggtcgatggactggagtgcctgccacggacccacctacaatcataacacgaatgtagcgcccccggcaaaagggacgtcagcacatttgaattgtactggtatatgtataaacaaaccccgtaccaagtaaactcaagccaaaatatgcataaccaaatagataactgaacaacaatgaaaacatcagccaaacacttcacaacaaacagttcaattagccaaacaaaggggcaatcagtgccccacaggtttcaaactctcctgctgtctcctttcacactttcacattaatcacttttcagtttcaattcatttcattgtgatatcgaatcacatttccacccttattacctcggccacccttattacctcggccacccttatcgccccaacccacaccttatttcaccgtgttgcggcgtgcaacccgaccccgcctgacagtttcaatttacaaacagcaaacatcacaataacaatttcaaagaattaacagtggcacttactagaaagtaatcacaaccaaagataagatattccacaaccgagcaacaatagtttattcacaatttcatattgccataatgtttccatttccaccatttcgtgaaccatttcaatttcaaattcctcaacttccaccacaagatgttaccacatgaatatcacacaatgattccccataggcttcgagtaacaacaatttcacatgccaacacagggcgatttcacaagattcagagttagccatacatacctcaaatttgccccttaatgatactacaatgatccaaattatttaagcaacttcaatctacaatacattgttcaatggaacgaatattagtaacaaactccataacttaagccaattaagcatattatcaaacaccttgtaggcattgattattacatgtaacaactatgatatttgttcatacaactatcacccttaatcaacaatttatttcaccctcatccctaacaatttataacttccaactacacatgtatgatcatttattcacacacaaccaacaattcttatcaaatatttaccttttaatctctacaatagctatgtaattatatagagaatttatagctcccaataatcatcccatgagttctaaagtgtacaacatacatgaataatcactatagagtagttagatatgatatacataccttgtgtagtaaggattttaagaatccccacttgagatgttcttgatggattcaagaatttgaaggaaaatctaaggatttgaagattgatccttgttagaataagtgtttaggggttagaaatcactcaaaatactcacaacaacttaccttgggtcatggagatgaagattgtgacgaaatttgcttgagagaacaaccctaagccccaaaaatgagtttagaacactccaatatcggtttagaacacttaaaaactttccaggtacgcgaaacgcgcgatgtcgcgcggtcttcgcgcgtttttgctgaaacactgcctcagacgaccgaaaatgcgcgatatcgcgcggtcttcgcgcggtttgacacctgtccagtcaaatggtcataactttttgtatacaactccaaatgatgcacggtttgttgcgttggaaactagactcacgggaatttaatttgataggtagatccccacataactcctaatataacaggagatatgatcgttcaaagtgaggtcatgtgcgcattcattcacagatttcgtcaaatctgaaattttccaactttgcttagacgtaggcttctccttagaccccaattcacttataatatgacttataagcttgttaacataaccaattgatattcatcatttcattaaccctcatttacacacaaaataaaataattaacctagcttggcacgacgaaatctcaatttgcttgcaaaatattttccggggccttacattctcccccccttaggatcattcatcctcgaatgaggattgaggttcattcattagccacccttatgaacttcagcccttctcacattaagaagtgtatcaacaattctcaaatttggctaactccttaaatttccgaaaatttcgccagagtttcctttgtaacttggcatatccacctgtcagagagcccccgaaacacatttccaagtaccattacaacatatgcatttcacaataatcattcccttatcacctgagttcttacaaaaccttcatttaccaaaaagaggtttgcacatgactcaaataattacaacacatacaattcttgtgcaacttgagaaagtacaatagtaaaacaaaatggggtgtatttgcaccgaatagagcataacatcagtttttctagagataagggctcgtacaatcactactagatttgttcaaatatatggggttatttttctttcatctccccttccgcttcccacggggcttcctcaatttgttgattccgccacaacactttgactgaagcaatttctttatttcgcaatttacggacttgcctatcaagaatagcaacaggaacctcttcataagacagctcttcggtaacctcaatgtcttcaattggcacaatcgctgacggatcaccaacaacctttctcaacattgacacatgaaacaccggatgtactagagacatttcggaaggcaattccaacctgtaggcaacctgaccaatcctttgagtaattcgataagggccgacatacctaggactcagtttccccttctttccaaagcgcatgactcccttcataggagataccctcaagaatacccaatcacccacttgaaactccaattctcttcgacgcacatctgcatatgatttctggcgactctgtgctgtttccatcctctcctgaataactcttaccttttccatggcctgttgcacaagatctggccctagcaactctgcttcgcccacctcgaactatccgatcggggacctacaccttcttccatacagtgcttcaaatggggccatctggatgctagcatgataactgttattataagcaaattcgataagaggcaagtgatcatcccaattacctttgaaatccaagacacaagcccgcaacatatcttcaagcgtttgaatagtccgttctgcttgaccatcggtctgcggatggaaagccgtgctgagattcacttgagtacccaacccttgctggaatttcttctagaaattagctgtgaactgagcccctcgatccgagataatagaaagtggagtaccatgaagcctcactatctctttgatgtacaaccgcgcatactgctctgccgtgtcggtggacttgactggtaagaagtgagctgatttggtaagtcgatccactatcacccaaattgagtcgaacttgcgctgagtgcgaggtaatcctaccacgaaatccatattgatcatctcccacttccacattggtatctctataagctgagtcaacccaccaggtcgctgatgttcggccttcacttgctgacaatttgggcacttggacacgaagtccgctacacccttcttcataccactccaccagtaaatttccttgagatcgtgatacatctttgtagagcctgggtgcacagaatacctggaatgatgagcctccgccattattctttctcgaagaccatccacatttggaacgcacaacctgctttggcaccgcaataccccatcactgctgccgagtgaaaatgctgaaatcttgccgcttagaactatttccttcaactgagccaatgtcgggtccttgaactgtttctccttaacttttgccaccagtgatgattctgttgtgttatggactatgagttgctcttcatttggggctgaaatacgaaccccaagactagccaactggtgcacctcccgagctaagagcttctgatccgccttcaagttagccaagctacccatggacttccgactaagagcgtcggctactatgttcgccttccctgggtggtacaaaatgttcatgtcgtagtccttaagcaattccaaccaccgccgctgcctcaagtttaactccttctgcctaaacaagtattgaagacttttgtgatccgagaacacatctacatgaaccccgtagaggtagtgccgccatattttcaaggcgaataccactgctgcaagctccaaatcgtgcgtcggataattcttctcatgatttttaagttgccttgaagcatatgctatgaccttcccgtgctgcatcaatacacaccccaagccgaccctggaggcatcacaataaaccacaaatccctctgtgccttctggtaaggccaataccggtgccgaggtcaatcttgacttcaattcctggaagcttttctcacaagcatcggaccactggaacttgactgatttctgtgtcaattttgtcaatggggaggcgagggtggagaatccctctacaaacctccggtaatatcctgctaaccccaagaagctacgaatctctgtcggggtagtgggtctaggccaatccttcaccgccgtgatcttctgagggtccacctgaatcccttcactggataccacatgacccaagaaggtgacagactctaaccaaaattcacatttggagaacttggcatataattggtgctgataaagagtctgcaacactgctctgagatggtcggcatgatcctccctgctccgcgaatatacaaggatgtcgtcaataaagacgattacaaaggaatccagaaatggcttaaaaacccgattcataaggtccatgaatgctgccggagcattagttagcccaaaagacatgaccaagaattcaaagtggccataacgggtcctgaatgcagtcttaggaatgtcctgctccctgatcttcaactggtgatacccagatcgcaaatcaattttggagaagaactttgcaccttgcaattggtcaaacaaatcatctatccgaggtaaaggatatttattcttgatggtgaccttgttaagctgtcgataatcaatgcacatccgaagcgacccatccttctttctgacaaaaagaaccggagcaccccacggcgacacactcggccgtatgaaccccttctctaataaatccttcagctgctcctttaactcccttaaccctgctggtgccatcctgtatggtggaatagatattggctgagtatctggcaatacatcaatcccgaaatcaatttccctatctggcggaattcctggaagctcatctggaaatacctcaagaaactcattcacaattggcacggactcgagggcagacacttctgaggtggtgtctgccacccagaccaaatgatagatacaccccttcttaatcatctttgaagccttaaggtaggaaataaacctaccctttggcactataccattccctttccactcaataaccggctcattagggaactcgagtttcatgactctcgttcggcagtcaagtttagcaaagcacgaatagagccagtccatacccataattacatcaaaatccaccatcccaagctcaataagatcggtcgtggtatcacgaccacatacagtaacaacacaatttctataaactcgtgtggctgtaatagaatcaccaactggagttgatacggagaacggctcatgaagctgttcgggtgctatcccaaaacttgaagcaataaatggggtgacataagacaaagaggaccccggatcaataagaacataacaatcaatggcctgaatagacaaggtacctgtaacaacatctggagaagcctctgcactctgacggtcactcaaagcatagaacctgttagacccgcccctaccacgggctccacccctagctgtaccacgccctgctggagctggagggcgtgccgctgacgtggcgactgatgaactggatggctgagcagatcctctacccataccctgcctgggcgcacgacaatctcgctgaatatgacccctcaacccgcaattgtagcaaactggtgcatccaggtaacaggcctccgtatgaaatctcccacacttgggacaaatacctccctggggtcgaggcctcatccccgaatgactaaactgtcggggcctcttgctatctgaaccgggcctcgaagagctaccctgctgatactggtgcaaggatggtggtgcactggccgaagactgagcataagactaagatggccctgacggcctcctccccggaactgacctccctgaatgacccatagaccgggccctactgctggtttccctgtctgcccgaatcttcaactttctagcctccgtggcctgagcaaaccctacgatcttcccataattcatatcttcatgcaaagccgctgtagcagcctcattcactaccaatgggctaaggccatgaacaaaccgtcgaactctggcctccatcgtcgataccagctggggagcatacttggacaacctcacaaactccatgcggtactcccaaacactcatagtcccctgcttgagcacctcaaactctgtggcacggactgccattgtctcggcaggtaagaaatggtccgtaaaggcatccacaaactcatcccatttggccggaggtttttcctcctcccgagaattctcccacatgtcgaaccaggagcttgccgctcctttcaatctaaaggacgccaactcaaccccctcggtctccgtagctttcatcacccgaagaaccttgaacatttcatcaatgaaggcctgaggatcggcctctgaatctgtacctgaaaactctggtggagcgagtcgtagaaactcctgaactctagaaccggaggaatctcgcggtccgctgtaagacatagaagtaccctgggatctctgggcctgaggagccacaagctgcgtcaacatatggattgctcccctaaggtccccatcagaagcctctggactaggagttggagcaacattcggtctaggaactggagcatcattcggagcaggaatatcggcaggagggtcaaagtcaccctcagccgtggctggagctggaccatttgggtcaggaatggatggagctagcaagttcagaacaggaggatcactttcttccacgacctccggcacactattcgcagccgcactggatgtggcattggcccctaggccgaatctagctttcttcttagctgccattactgaaaattcgaaatagagcacgaattagacacaacatcaccttatcgcacgaacttggaataacaaagaagaggataatttttcctaaatgcccatgcagccccctcctcttcgatgtggtcgacaacacaccgattagaagggctctactaggcacggctccgagacatcctaggactcctttaaaaccttaggctctgatacaaagtttgtcacgccccaaaatcgagggatgtgaccggctctcgaccaagtatcctcagtcaagcggacctaggtgcctttccagtcccacgtgttaccccgcttattcattacttataagccaagtgaaatagccatttataattgaaacactttttacaaacatacataacatacgtgatccttaacgttgtttacaacttacatcgcccaaacatacgaaatacatatttacatagactcataacccacatctttctgtctacggagcctctaaagatgaaaaagaaataatatagtacttgccggtaacaaggctccggctataccttatacaaatatcaaaacaaagtcctgaaacaaaaacgacacgagccatgaaggaccccgaatgaaaaagggctcaccaactcaactgataggaagtgatgaggagctatggtcgatggactggagtgcctgccacggacccacctacaatcataacacgaatgtagcgcccccggcaaaagggacgtcagcacatttgaattgtactggtatgtataaacaaaccctgtaccaagtaaactcaagccaaaatatgcataaccaaatagataactgaacaacaatgaaaacatcagccaaacacttcacaacaaacagttcaattagccaaacaaaggggcaatcagtgccccacaggtttcaaactctcctgctgtctcctttcacactttcacattaatcacttttcagtttcaattcatttcattgtgatatcgaatcacatttccacccttattacctcggccacccttattacctcggccacccttatcgccccaacccacaccttatttcaccgtgttgcggcgtgcaacccgaccccgcctgacagtttcaatttacaaacaacaaacaacacaataacaatttcaaagaattaacagtgccaattactagaaagtaatcacaaccaaaggtaagatattccacaaccgagcaacaatagtttattcacaatttcatattgccataatgtttccatttccaccatttcgtgaaccatttcaatttcaaattcctcaacttccaccacaagatgtgaccacatgaatatcacacaatgattcccacataggcttcgagtaacaacaatttcacatgccaacacatggcgatttcacaagattcagagttagccatacatacctcaaattcgccccttaatgatactacaatgatcccaaattatttaagcaacttcaatctacaatacattattcaatggaacgaatattagtaacaaactctataacttaagccaattaagcatattatcaaacaccttgtaggcatagattattacatgtaacaaccatggtatttgttcatacaacaatcaccattaaccaacaatttatttcaccctcatccctaacaatttataacttccaactacacatgtataatcatttattcacacacaaccaacaattcttatcaaatattcaccttttaatctctacaatagctatgtaattatatagagaatttatagctcccaataatcatctcatgagttctaaagtgtacaacatacatgaataatcactatagagtagttagatatgatatacataccttgtgtagtaaggattttaagaatccccacttgagatgttcttgatggattcaagaatttgaaggaaaatctaaggatttgaagattgatccttgttagaataagtgtttaggggttagaaatcactcaaaatactcacaacaacttaccttgggtcatggagatgaagattgtgacgaaatttgcttgagagaacaaccctaagccccaaaaatgagtttagaacactccaatatcggtttagaacacttaaaaactttccaggtacgcgaaacgcgcgatgtcgcgcggtcttcgcgcgtttttgctgaaacactgcctcagacgaccgaaaacgcgcgatatcgcgcggtcttcgcgcggtttgacacctgtccagtcaaatggtcataactttttgtatacaactccaaatgatgcacggtttgttgcgttggaaactagactcacggggatttaatttgataggtagatccccacataactcctaatataacaggagatatggtcgttcaaagtgaggtcatgtgcgcattcattcacagatttcgtcaaatctgaaattttccaactttgcttagacgtaggcttctccttagaccccaattcacttataatatgacttataagcttgttaacataaccaattgatattcatcatttcattaaccctcatttacacacaaaataaaataattaacctagcttggcacgacgaaatctcaatttgcttgcaaaatattttccggggccttacaatcatcatctaaggtcagctgcttggcacctccacgctgcaccgtgtctctcaagacacacaaatagggatcatcaattggccgatcacggatacgctccaataatgaagaacgagcgaccgtgcaagctaacaccccactaggctcagaaatatccaactttacaagttgattggccaaggaccgaacatccaaaacaagcggtctctagctgaccggaatgtaagcaagacagcccatgctgactgacatcctactcaaagcatcggccaccacattggccttcccttggtgatgcaagatagtgacatcatagtctttcaacaactccaaccacctcctctgtctcaaattcaactccttttttcttgaacaagtactgaaggctcttgtaatcggtgtacacctcacacgtcacgccgtacagataatgcctccaaatcttcaatacatgaacaatggctgccaactctagatcatgaaccagataattcttctcgtgaatcttcaactgccttgaagcataggcaatgactctgtcgtcctgcatcaatactgcaccaagcccaatacgggaagcatcacaatagactgtataaggccctgaacctgtgggcaaaaaccaacaccggtgccgtagtcagagctgtcttgagctactgaaagctcgcctcacactcatccaaccatctgaactgggcaccattctgggtcaacctggtcatcggggctacaatagatgaaaacctctccacaaaccggcgatagtagcctgccaaccctaagaaactctgaatctctgtagctgatgttgatcgaggccagttgttgactgtctcaatctttttcgggtccacctgaatatcctctgctgatacaacgtgacccgaaaatggagggaggtgaaagggagttaagaaattctaggtgacttcatatttgggatatacaacccatataggcaaatctgggggacatcaaaacatattagtttaaagaaggataacaaattaaaaaataaaactcctccccaccgaatttgtgttaatttttgtttttcaaaattcaaactatgtgaactttgatcgatattttaaaatatttattttcatcatattaatatgagaataattgcaacatacaatacttttcatataatttttgaatattaaaactttaattttagaatattaagttaatttaattttaaaattgcattaattctcgaaaagtaaaaaaacaattattatttatttacgatgaaagaaataataataaaaaagaggtggagggataaaagcaattagtcaaatttttgaaaagtcaactcagaagaaaatggaaacctagaggaatcccactcataagtcataaccaacactagtaatccaccagcgttcaagttaactttctcaccacttgttttttgtttaatattttatttagtttataattctctattaagttactttacaaagctaacaagctgatagataattaatgtatcagcttgactaaaaattattttcaggcgtaaaagctgggtgatttgcctgttaaaagacttacattctttcgtatattgatatatatttatcaacttgcttgatatatattccacgaatattccatccatgcatacgtattttttctctttgaaaatgaagagttataaatgagtcgatttaggcaccgcaatctcgtcctaacctctccatggccatgtctttcgtcgtgtatttgcactttagatctcatgacttgacctgtagatagtaatatcatcatctttttggcgacgtgatctttttttattcacttgtactggtggcagagaggtcggcacatgtgttctgactctgatctaagttctatcacatcatacttcggtactgctttcatactattttcctcgaatatcgagcctaaatatttgaaccgtttgcattaatttaaacaccataggtaagggcgagctaggagcttatttcgagtatttataattttggtggcaacatgtgataaatgaatgatatgattctcaaggagttacacgacagctatgtgatgatggatcaaattattggactaatcttatatcaatttacctcttcttatactagcaattaaaattgcggtaaaacaaatatatatacttttgctgttttaaaatccttactctctatatgcttcttaaacttttggtagacactctcgtttagctaattttggcatgatatcatcaaaaaatagcataaaccatgtaataactgtaaaggataatcctacaaggactctactcctatattttaggattcttgtagccaacgaacttgtatatctctaggcataggagtcttatacatctgggaactctttttatatatattggggttgtgtagtcatgttttagtatgagaataaaacagctttacatggtatcagagccctaagaggtttaacaacccaagactgtctttacagaaaagaagaagacgatgactggtatgggggataaaaccaattcttcatccgcctctcagtctcccatatcttactctatgccttccccaaatatggcacatcagctaccggtaaagctcatgtctacaaactttctgttatggaaaacacagtttatgccgatggtgtgcggctgtggactcaactatcacattgatggtagtgaaccagttcctgaacctcttttaaaggacagtaaaccaaacccagcatataaagtgtgggtgagagaagaccaacttgtattaagttggattgttgcatcagtttcagagggtattttacctcaattagttggagcgcagagcgctcgtgcagcttgggataagcttgttgctgcatatgcttcaggatcgaagcctcaaattcgtgaacttaagatgcagttgtatacttcgcgttgtgataatgcgagcattgaatcttatatacagaaggcaaaaggaattgcgcatagactagctgcgctacaacatccgatttccaatgatcatttggttgaatttgttcttgctggactaggtcctgtttatcgtccttttactagatctctagaatcgcgtcaagaagatattacttttgatgctttatatggccttctcctgaatgaagagcgacaattaaaaagagatgagaccattaatgtcattgcacccacagcccactttactaaaagttccttttctagcactcaaggacgtggcagaggacgaggagggcgtggtcgtggacgctcctccaaccaagggttcacccagcagaactcttatcatagttctccagcatctaaccagttgcccaaggcacaaccacaagtttcagaattttcagggattatttgctataattgtgaaggtaaaggccacattgcacgtgtatgcccatcacctaaagccaatagtggcagcatggtgaatggttgacttatttccaattttgctggttctccaaacccacctacccaaaattggttgatagatagtggcaccacacatcatatcactgcagaccttgataatctaggtatccactctgaataccaaggttctgaagaagtgacactaggtaatggctccaaattacccatctctcatgttggtaaaagttccgttattgtctctaataataaattaaatcttgataatattttacatcttctcactactactcacaatctattatcaattagctcttttgccaagtctgataatgtgtctgttgaattatttcctaaccatttttttattaaggacttggcaacgaggggaatccgatatagggggcccacgagtgaaggcttatattcatttccagtgttgaaatcattatcaccagtttcatgtgcagcttcccttggagtttggcatgctcgtcttgctcatgcatcctttcctactgttcgtcatgctttaccagccactactctcacctcatcaacgcataaaaatactagtatatgttctacatgtgctgttagtaagagccataaaatttcttttagtgagtctagttttcaggccacagggcctttagatttgatatgttcgaatgtttggggccctgctccagtagtttcacaggatggttatcgttattatgtcatctttttttatcattttagcaaatatacttggatttatttccttcattttaaatctgcacctcatgctgcattgtataattagtgaactcatccgtacaattagggtgaaaaattatccatttaggggttgtttggtacgaggtataagaaggtataatgttgatataaaaatttaataccactttaatactttgtttggttagcaaaccaggtataagttatcccgggattaaaattaacgcggggataacttataccttcttcttagaaattatacaattatcatttttaatacaacataccaaacaatggataaaaaacaatcccaatataactaatctcagcataacttatcccggcataaaccgtattcaagccaaacgacccccaatgtttatggtaaactctttcgtttaaccgatatagcatccataaatagctagtaaaattgttctattaagtctactacgttagaagttatctaatattcgatatttaattaattaccctcttggtattgaaacaaaagaataagtcggtcattaattattgaaatttctgttctaaaataaacttttacaataataaatcgaataatttctgacacctctgtccttcaaccaatatttaataatcacttaaaataatttaatcttcccttaatcattaaccttcctgacatatacaaatgattccttctatgctttgattggaagagacttctgcgatgtttagtggaaattattcactgccttcctcctatttcatagtgttttttttttcttcaaaaaatagtttaatttttgtggatttccatataatcttttaggttataaaagcacatgttttcacgtaattgtaaaaatatcaaaatgtatattctagtaaaactcatccctgataaaaaaagaaattacttaaatttacgggatcgattaaaactcatcaataataattaaaaaaaattcaaggattatactgagatgaataaaattcttctatcctaaatcaaaggtttcgagttcaaactatgaatataaaaaatcttaaaagaaagtgctttcccatttaatggatcttacacaacgtgcgttttaatttatcggagccataatacggatatcgggtggaaattaaactaaaaaaagaggttaaaacattgtgtattacttcaaaaaaaagaagaaggaattactagtacaagaaaacaaaaaggaccgttctaagaaaacctacagtgtcagaaaattaaactatttttaaagcttaataaaaaatgtttttacctcgatagttgtgcctgttaccaataagaaagcaacatttttccctagacaaaggatatataaatatttaattatttggtcaaaggaagctgtaaatatatagtatgtgtgagttcaatgattaaatgtcacgttaggatcaaattgggttctaccagtaatttttattgagccttcatttatcctttctagtattattatttcatttaccatagtcttttttttttcttattattattatttttgtaatattttaattgggggctaataaatattgttctttgccgacatagaggcatctttgaagtttgaaactgaaataaaattaatgcaagttgtatcgaacaggagtggctagtgtctaataatattagactatgtaatagtcaacaatataatacgtagtcaaattaggaacaaatttgtatgtctgtaaaatgaaataatactgtagttgctatgcttgaaatatagtgaaaatagcccgggctagccagttttcggattgataattgaaaacagttagcatttgcaaagtcattgaaaaatagtcatttttctgcggagataaaatctaaacaaaaataccacagccgaaacaaggaaagttccatcataatatgatagattatggagctcctccgtataaacttctagtatattatgttggaactccagcacattatgaaattccaacatattatggtggaatctcatatgtaaaaaattcgaaatctaccatattatgttgtaatttttcgaatttttaaggtacttttattcaaattttatctttacatgaaaaaatggctaaatttcaattacttttgaaactatagctattttcaattaccggctagttgaaaatcaggctatttctgattttttttttttccccctgaaatatagcttcaacggtgtgattcttttttttccgttccctaagctatgattcaatagggaatatttgaaaaaatattagcaatgcaaatattttcacgaagaacattggctcctttaagttttatgactttttaaacatatttgcacagtaaataatgaaagaaagaaaaagattttcactctagataagtcaaaacagcatgtacattttttattctttaattctatcatactaaaagaaatcaaggttaaaaaaaaaacatacagcattatcattaaagaaacataattttaaaaaggaaaaaggtaaataacattaaaggcacattaaatatgtagctcaagctgagtctcaatatatatatatatatgaatgtagatatattagaaatgtcaatatatatacattttaagaaatataatgaattagatctctatcattagtggggattgatctatttctaaaaagaaatacacatattaattatggagacatggtatataatcacaatcaagaagtccaattaaggggtcgtttggtttgaatacggcttatgccgggataagttatgctgggattagttatactggtattattttttatccattatttgtatgttgtattaaaaatgacaattgcataatttctaagaagaaggtataaattatcccggcactaattaccccatcctctacaaggtataagttatcccagtattaattttaatctcgggataacttatatcaggtttgttaaccaaacaaaatattaagattgtattaaatttttatatcaatactataccttcttatacctcataccaagcgactcctaagtatataagatgactagtattaatgaatgaataacaacatgaatcgaacttatcatgtcagggtcctaactcctaccagcctaattgggttgggtttccctttttctagtcattttgatttcaaacgacaatgtgaatatgtgataacaatattgataacagtgacctacgcagtagtatttgttggtttttttaagcttaatgtagcttaaaagagggcgaacggaaaatgaaggtaaaatgaagtatttgagtttcatttgacaatgggatattgttccgtattagaagaggaaaaagtttttgatgggtatatatatatttgctcttcttctagctcttaaagagttaagaagaaggcaagcctcacgccgtcgtcgctcggcttcggcttattgattgattgattaattttttcggaccaaatttatttgttaagaataaatattaacagaaatgttatcaaatatcggttctttttgtaaacgcgcgaaaaattaatattaaatccaacaaatattaatattaaatccaacggaatattaatcgttatccgtttttcgttttccatttttgtaactgaaaagttaaagttcctcttcgattcccggtttattgttacataaatagccatttattttatggcatttatgttatggccgttttacataaacaacctttctgaagagttgcgcctcttcaatttgagctcaacattggctataaatacagtccattctctcagattttccatacgattttctgagttctccttctttcttctgccttgttttaacttcaaagaaagtaacagtaagtatgatttgctaccgatctttgtattcgctaaaatactggagtttgaagtaccgctacaccaatgtgtaattcgttctatcctgggaggaaataattcataaccttgggtactagggattaaattccttaaggaaacactgtaaattcagtgggctcagattaaattttgtttcagtttttcatttctgtttatacgctattttatattctccagaattatttttacgaatacaggatactaagaatattttgtagagaatatatctaaaaggtttggccttcggatcggtcaggctaatgtgatcttgttggatgatataagagcaacactgtaatttcacctctttatgttagttattaagtaaacgttagttagttaataattattagagtagaggttaagagttagttaattacacctactatatatatcaatgtactgatagttttacatttaattcaagtaatgaaaatatacttcctctatcatctctctctatcattctcttctctgtatttttccttctcctcctcaaattatgacatggtatcagagcatatgcttgaaaaatcaaagctcgtgttctgaacttcttcttccgcattctttcttctggaaaaatctttgaaattctgaaatcttgatttggaaattttcggattctgaaattcttggaaaaattctgagtttgaagctctgcatgtcataatcaaatattagattcttgacaaagattcaaagaaatcaacaatggcaataaatgaaggagtaccaattgtgaattctgggcaaaacagtggaaatcaagcaaatccagcaactgggatcgattacaatcatcctcttttcctttctcctgttgatgttagtggaattcagatcattttgttccaattaataggtattgaaaactattcaatttggattagatttatgcgagttgctttgttaggtagaaacaaacttggcatggttgatggtacatgcagtaaggataagttcccagattctatggggaatcattgggaacgtgtaaatgccatagttctatcttggctgatgaactccgtggctaaagggcttcttggaggaattatgtatgcctctagtgcgcaaactgtttgggaagacttagctgaaagattcaatgaagtagatggctcaagaactttcaatttacataaagaaatagccactttaactcaaggatctgcttctgtctcagtatttttttaaaaacttaaagatctttgggaagaatttgaggctttagttcctgcacctggatgtgattgtcctaaatcaagagattttgttaactatctgcagaaattaaggctatatcagtttctaatgggactgaatgagtcctattcacaagctagaagtcaaattcttatgaaaacccccattaactattgtaaatcaagcctatgccttaatagtgagtgatgaaagtcaaaaatctgtagctgctaactctgggatacttggagctaaccctgtaggaaattttgaagttgcaatgtatactaggcatggtgcaggtggtcaaggtcaaaggttcaagaaaaacttcaatttgcaatgtgattattgcaagatgaagggtcatatgaaagaaaactgttacaagcttgttggataccctcaagagttcagacaaaagaaaaaaagggggatataatgcagctcataatgtcaacttcctgaatgaaaatgctgacaatcaaaatcagaattatgatgcacctactgttgcatatggaaaaaacactagtggtttaaatcagtctgcttgtggaagtcaggtgtcttatggtcaaggattagagaggttgcaaaccaactaagaaacttcacattctcaaaggatcaatatgatcaaattgtgcagctgttaaacaaagaagtagcctcaacaagcattaacaatgaagattcagctgccaatgcaacaggtacagatactgatacaacattgttgatctcaaatggttcacatgattggattatagacactggtgcaacaaaccatatggtatctgataacagtcttctaaatgaatactatagttcagacagttaatcctaagaaggttttgttgcccaatggagatgtgtctctagttacacatacaggggcaagctcaatttctgataagagtactatatctaatgtctttgatgtgcctcaatctaaatataatcttctttctgtctcaaaaatgacaaaagaactacaatgtgctgcaacattctttcctaatttttgtgtttttcaggatctcttcactgggaaggtgagggagattggtaaagaagtaagagaggactatacatactactagccagattggccaggaatagacaaaaagctgagtatgctgcaagaggattaacagcagaagaagtacattcaataaatatggagctattgcatcaaagacttggacatgtgtctgttagtaatgaagaaaatactacctatcagtatacggaatatcagaaataaaatagatagttgcacaatctgtccctgtgctaaacaaactagattacaatttccttctagtgatatcagaagcatgtattgttttgatttgattcatgtagacctatggggtccttacataatagctacatttgatggtaataagtacttccttacagttgtagatgactatagtagaatgacatgggtatttcttctcaagcaaaaatcagatgtttatcaatgcttacaacatttcatcagttttgtcaagactcagtttagtaaagtcatcaaggtcattagaacagacaatggtacagaatttgtaaattctttatgtgagcaattattcaaaaatcttggaatgatttatcaaaagagttgtgcatacactcctcaacagaatggagtagcagagagaaagcacatacatattttagaaataacaagagctataagattgcaagctaatattcctataaagttctggggtcattgtattttagctgcagtatatattcttaacagattacctagctcagtcattgcaaacaaatctccttatgaaaggttgtataacagaaaaccctctctaaagcacttaagagtgttagggtgcttatgctttgctaaagtagttcaggaacaggacaaactaatgtctagatcaagggtatctgtgcatataggatattcagaagttcataaaggctatgttctatatgatctagggaataagtcattcttcatcaacagggatgtaatattcaaaaaaatatattcccatttaaaagagcagaatcctcttccactcctatatttctggatactacaactaatgtagaaccatacatgcacaattcagatgcattcttggaacaaaggtttaatacaccaacagatacaggaaattcaaggaactcaactacggccaatgatagtgcagcagagaactacaactctgagtcagtgcaggattttcaaaatcacaatacaactgaagaagatatacaaacatatcagaactatcacagcacaacagaaggggagtcacaagcacaacagaactgtcaaagcttatctactgcagctcctcataacagaaatcaagtgatttcaaatcaacttactaccagaaaatccaccagagataaacaaccacatgtatggctgaaagactttgtctccctaaacattcatcaagaggtaccttatgcattaaacaaatatataagttatgatccctatctcctaaatatcaagcctgtattgctgctttttcatcaactactgaacctacctcatatgctgaagcaagcaaagatccaagatggatacaagccatgaaagaagaaataaatgctcttgaaggtaataatactgggacactagtcacattaccagaaggtaagaaacccataggatgtaaatgggtatataaaattaaatacaaggcatcaggagagatagaaagatttaaagctagattggttgcaaaagggtacagccaacaagagagaattgattataaagaaatattctcaccagtggtaaaaatggtgactgttagaataatactagctctagcagcagctaaacaatggcatatacatcaaatagatgtatacaataccttcttacaagatgatctactagatgggatctatatggacttaccacaaggatttagcagtcacggggagaagagagtatgcagactcactaaatccttgtatggtctgaaacaagttcctaggcaatggaacttgaaactaactaaagtattgttgaacaacttacagttcaagcaaagtcaatttgaccactctttatacataagaaaaacaaaagaaagtatggtgttagttctgatctatgttgatgatatgctgattattggaagcaatctaaagttgattcaagacacaaaaaattctctacaaaatatcttcaaaatgaaagacttgggggagctaagatactctctgggattagaatttgctagatttgataaaggtattgttatgcatcagagaaagtacacattagagcttatagcagaagtgggattaactgtagcaaaaccatcaactacaccaattgatatcaacactaaacttacaacaaaacagtatgatgagcacatttcaaatgatggaagaacggttgaagatcctactgtagatcagacagcttatcaaaggttaataggtaaactcttgtacttaactgtcactagaccagatataacctatggagtgcaaactctaagccagtttcttcagcaaccaaagaaatctcatatggaagctgccttaagaattgtgaaatatgtgaaaaacaatcctggacaaggtatactactatcaagtcaatacaatacaaccattacagcatactgtgatgcagattgggcagcttgtccagtcactagaagatctgtcataggttttttgataaagttaggcaattctctagtgtcttggaaatcaaaaaaacaaactaccatatcaaggagcacagtagaagcagagtacagaagcctagctgcaactgtagcagaattaacttggctagtgggaatgttaaaagaaatcaatgcagaagtaaaattgccagtggatatatttactgatagcaaagcagctattcagattgctactaatccagtctaccatgaaagaaccaaacatatagatattgattaccaattcataagagaaaaaattcaacaaggattaatctgcacaaagtatatacctatcagagatcaacctgcagacttgtttacaaaaggactaagcaaatttcaacatacatatctgagttccaagttaggtgtctttgatatttttacaccgcctaacttgagggggagtgttcgatgatataagggcaacactgtaatttcacctctttatattagttattaagtaaacgttagttagttaatagttgttagagtagaggttaagagttagttaattacacttactatatatatcaatgtactgatagttttacatttaattcaagtaatgaaaatatacttccgctatcatctctctctctcattctcttctctgtatttctcctttctcctcctcaaattataacatgaggtggagggatttgaaggtgacaagggcacataagcaaattgctcaactaatatcccattggactttttatcttaagagttcgaaacaaaatatataaaaatttgtcaagattaataggtccggtgatccctctgctcaatacataagtctgtctctgcatgcgatgtcgaggtcaatgaggaatatatatatatatatatatatatatatatatatatatatatatatatatatatatatatgagaaaaagataagcataagcacttgagaaggctttagatattcacgtaaccatttttatctcttttagggaagaaaagatcaaaagaaaaggacctaacttgctcgggtgtagggttaggttgccattaactgtttattattcctaaaaaaattcagattcagagattctaatcaaatttttgcacaacagtttgaatacaaccttacgtatttgccctcctttttaccctaattaacttagagtttattggatttaagatttttataatattagtgtaatttaacctgtgatagcaagcatgtactaatttttactatgttagagtcttacaaaaattcaattatcttataattaaaaccttattgtggaaaaattaattctttacattgttaacggatagaatttaattaaactcgagtttaaagtgcatgttaattatcatttttgagaaactacgtatacctaaacatgaatgactttgtgaaccatatgcatatcccttcatattactgtaaacaactcagtatctagaaagtcaaagactccattgctatgtattcaaatgtacagatagaatgtatgcatttaaacgaatagtacagacatgcatttattaaaatgattaacgtgtaagaggaaagatatgttggctggagaaaggatcagagggcggtggcttgtggagtataaagaaaagattgttttggtcagcaaaaagtcagatttctgtcctacaattaaacctatgcaaaagtgatggacggagggttgttagatcttgactgttttatcatcttaaatttcaattcccatgcaatccatgcattgcatgcacgcatctattattattattactatttttattttttatttttgcaaaagcggtatgtctatttcacgtatgtgatagcagcggtggagtcacaatttgaaacttatgagtatggaataatagctcatttaagtttgttggattataacaacaacaacataataccagtcttatcccacaccgttgggcaatggcgaagctaggaatttctctaagggtgttcagatttttaaaaagtaaaatttttttacgacaaagagtgttcaatatgtgttatatacctctaaaatataatattttacttacgtatacagtgcaattttttgacgaagggtggtcagttgaccaccctcacaagcatgtggcttcgccactgccgtgggtctggggaaggtattgtgtatgcatacccataccttgtgaggatagagaggttgtttccaatagaccatcggctcagaaaagcataagcaccacattaataaaatatggacaagaatggacattactaaaaaccttataaaagcagaataaaaacaacaagacagtaaggtgatcaacaatgaaagaaataacggttagtcataaaaacctactaccaacagaaagcgagattgtgtgccaatactactgttatgaacactctagactacctactcttctaccctaatccatgacctccatacattcctatcaagggtcatgtcctcggtcagctatgaagatgcgacatgtcttgcctaatcacctcttccaacctcttctttggcctacctctacctctccgtaggccctcctatatggcaacctctcacacttcctcactgggtgtctgtgctcttcctcctcatatgaccaaaccatctaaggtgcacttcccgtaccttgtccttaatagggaccatactcaccttgtcgcgaataatctcatttctgatcatatctaacttgttgtgcccgcacatccatctcaacattctcatctctgttaccttcatcttccgtacatgagcaaatacatttaagttattcatcgcgattgatgacaaatacaggggtttgaaacaacattgttgataggggcaaagctagattgtcggctacgaatacagtcgaaaccaatagttttggttcaactctgtatttatcttaaaaatttattaaatttgtaaaaattattaatttaaaacttaataatttaaaaatattagaatttcgaactcataaacttttaaatcctgattgtctctagcaggcgaacccgtaacttaaactctagctccgaggtgatagttccaactgtacaaggtattgaataagtttgaccgtcaaaactctaggtaagtagaaataaattacctaacgtttttttttcagtatgacgatttgaacatcttctactattatttttaacgactttattaactgccataaccatactctgtgcatttacttttctagctgtttatagtactgaaaactacagattctactgaaactgtaactgagaggtcatctttgtcagggccggatggagtatggtagttacgagttcaattgaacccctaatttttgaagtagaataaaaatttatgtgtacaaatttattaaaattgtaaaaataatatatataaactcataactttaaaatataataggtttaatattaaaaaaattaaaattaaattcattaaatttaaattctggattcacattttatcttttgttattggaattgccttagacctcaatccgctgaaaaacatactagtaaaaaatatagcacgtggtcactcaagaaggtggcagaattcctaataaaaagaagatcagaaagatgaattgtatcggccaccaatagaattacagtttccgtgggctactagtcccagtttatgctttatttttattttctttattaatacctcaatagtcaattttactaattatatatttttcttagagtccatttgtccaggaaaaaatgttcactttttttaatttttactatgttttttaaattagtgtttggctataaattttttaattttcacttgaagatgaattttgaaattttttaaaaatttgaaaaatttccaaaagttattttcaaaattttcactcagatcactcaaaaaaattcaaaaacaatccaaaattatattcattccaaatacaactctaattttcaaatatcattttcacttgatttttttttttcaaaattttacaattcttatgttcaaacgcccatttaattattttctcatttcgatatgtgattcgccaaaaataattataacaaagaacgccctttcagtttcaagagccagcaccttttggactgtggcagtgtaatagtacactaattactttttgtgacaataattatgaatgtaatataaatattaatatatcttaaattaatgccacgttacatataattttaatcgaaagcaatggatgccaatgttctttacaaggtgaatatggtctgggattacctatatattatgtcaaggatgaaaggaaaactatttaagatacaaaatgttagggttgaaaatgaattattttagttatttattttgattatttactcacaaaccaaaaaaaatatcaagcctataataagacaaaccacctctagttgcactcacaaaaaaacatatattcttcaacttggtaatcgagcttccacaccctcagactttataggaaaatgagtatttaatgaaacataatagtattactcctactagtagtacaagatcaatataggtttcctagtccatagaaatctacaaccttcttccaccacctactccaaaaaatagaataaaataaactttttcgaattacactaaagaaagaaggagtatcatcacttttagtccgcgccaaaaactatttatatatatttgataataaaaaatatataaaatttatataatatacaaaatgtatatatatacaaaaaaaatataaattttatatactttttcggttattatttttatagcgattatatattttcatttttccaagaaagaatccactatatatatatatatatatatatatatatatatatatatatatatatatatatatatatatatatatatatatatatatatatatatatatatatatatatatatatatatatatatatatatatatttccaagtaggtctaacttagagcccgtttggggataagaattttttcgctttttttgaaaaaaatttattttttttcgaaatcaatgtttggccataaaatttttaatttttacttgaagatgaatttaggaatttttcgaaaatttgaaaaatccaaaaaaattatttttcaaaattttcactcagatcactcacaaaatttcttatacaacccaagatatattcaatgtccaaacaccactctaaattttcaaataccattttaacttaaaaaatttcaactttttttttttagaattttacaatttttatgtccaaatgcccacttagttttttttttttttgaattttattggatgttcggtatatattggggttcgataaatttaaattcgcattgaatttttcttttatgaaaaaaaatgctatctaattaaggtaactctcaaatttaaactcgagacctctgattgaaaatgaaaaaaatgtgtatctctcgattagagagggctaacttgattgctttcaaaatgaaaaaaaaagaagaagagaagagaccaaactttctctctctagagtgacatttcctctcagcgaaagctgaaatgggaaggaaatcgaaggcaagagggggagggcgaagcaatcagatgactaattcgacccaaaatcatggaggaaaaggtattcctagaactgaggattcgaaaaaacagagaaatattaacgcaattacaggcatagtaccatttgagatggagcgagaaatggggaatacgccggtagttactccggttaaaactcagatcggaaacatgcaagggactggaacaagtagtcaatcctgggcggataaggtggaggaagaaagaatagtaaaggagacacaaacacatgagaagaaaacgtggagcagaattgtagctactgttccattggaagaaggagaagatctgaaaagagaatcaccaaaacatagtaatgttaaaattacagcagaagacatccatgaagaagtataattctgaaaaactggagtagtatgctatgtgctgggttcaaatccaccacaaagtgtaatggaaggatacttcaacagaattggggggaaattgggactagatctagtagcacaagttcaacgaggtgtgttcctagtcagatttcacacagctgaaagtagaatgaaagtggtagaggaaggagtccagatgttcgatagaaagccagtcattgtcaagccatggcagcaggatattgaagtgaaaaaggaaatcatggataacataccagtgtggatcagacttcctgggctaatcgtgaagtattggggaaaacaagcactagctaagatagctggaatggttgaaaatccattgaaatcagacaaggcaactaccatgaagggagagaacgacctatgttagagtattggtggaagtgccaattaatatggcattccctgaccacagtgatgtttgaaaatgaacatgggcagattgtagaacaagaagttgagtttgaatggaaaccaatactgtatacaaaatgaaaaaattatgggcatgaattgaaggaatgcaggaagtagataaaagaggagcaaaacaataaggcacaggaacaaggagaagaaataaaaactggtgaatacaaggagaaaaatggagcacaaacagtaaacaacaagcaagcagaagggaaagaaatcatagagcaaaaatttcaacaaagagcagggaagcaggtaatactgagataaaggcaggacaaatactactataggagaggttatgaaagaagaggaatagtgataagggatccagagattgacattgggaactcatttgctgcactaggggatcaaaacaataacaatactaggatagccaaaccccctgccctggggaaggtgaagctgaaaggggtcctaaactagggaagggtgggggaaaccccaacccaaatggatagcattggcttttggaatgccagaggtctaaacaagccagacaaacagaaagaaatgaacctgtttgtccataatttgaaggttggcttgtttgaatttctggaaacaaggataaaaagagctaaggcactaaatgcttctttttatctttgtcaagggtggtcgtttgttacaaacttagataaacatccagggggtaggatctggctgttgtagaaatcacatatatatgatgtagatataagggaagttactgcacaaatgatacattgcaaagtagaacacaagggtagcagaaggagattcaacctgactatggtatatggctttaatgaacaagctactagaaggagactatgggaagacatcaaccaaataggggctacaatggatgaggcatgggcagtgatgggtgatttcaattgtgtactgaataaagaggagagaatagggagcagagtcactatggctgaaacaagagactttaggcaatgtattgaaacctgtgggctaaaggagctaagatcctcaggggatttcttcacctggaacaacaaacaaggggaggaaagcagggtgtacaacagaattggcagagttttgattaacacagaatgggtcacagaattaccactatcagaggttcacttcatgcatgaaggtatctatgattattgtccagcaatagttaactaggaaggagggaatggaagaaggaagaagcagttcagatatttcaatatgtggagtatgcttccagaattccaaaaaagagttcaggaagtatagaagaaggaaatacatggcacaaagatataccagttggtagggaaactaaacaaaacaaggagtgtactaatgaaactaaacaaggaaagattctccgatgtagaaaagagagcagaagcagcaacggagcaactgacagaatgccaaaagaagattcaaaatgatcctaggaatagggatctaattaaagaggagattcaactaataaaagaaagtgtcagatggaagacaacaagagaataatttttgaggcagaaaagcaaagtgcaatggataaaacagggggatcaaaacacaaagtactttcatactgtgatcaaatctagaaggaatgctaataggatattttctattaaggatacagaagggaataaggaaaatggtgctgaagggataacaaaggcattcattgactactatgttaaactactagggaaaagtaaaggaaatagacaacatgtatacagcagtttagtaaagaaagggccagtagtacagaaggagcaaaaagtattcctagaagcagcagttacagaaaaggagattaaagaagcactttgggcaatatgtggagataaatcttcaggacctgatggatatggggctcaatttttcaaagattgctggccagtggttcaaaatgatgtgattgatagtgtaaaagagttctttgataccacaaaaatgctgagaagtatcaacagaactgttttaacattgatccctaaaaacaaccacacagacagtgtaggagactatagaccaattgcatgctgcaatacagtttacaagatcatctcgaaggtgctatgcaacagacttaaaggagtgctaccaactataatatcgaaaaattagagtgcttttgtagaaggtagaagcatagtgcaaaatattttgatatgccatgacctggtaaagctatataaaaggaagaaatcaataagaagctgcctaataaaaattgatctcaaaaaggcatatgataatgtggagtgggagtttgtggaagaaatgctctatgctttgaacttccctgtaaagttcatcaaatggacaaaggaatgtatgacaactactcagtactcaattgctctaaatggtgaggtgtatggctgtattgaggggaaaaggggcctaagacaagggtatccaatttctcccctcctctttgcaatatgcatagagtactttactagaattatgcactgggtagctgcacaagaggggtttgctttccatacaaagtgtaaagggttaaatctaaatcacctatgcttcatagatgatgtcctgatgttctgcaaaggagagtaccaaagcatcatgctaatgctgaggggattacaaaccttcaccaatgcttctggtctaagcacaaatgcagaaaaatcaagtatatacagtgctagcatggaagggcagtatttggagaacatatgtaaaataacaggttacaaagaagggaccatgccatttagatacctaggagttcctatagctgcaaggaaactgaaggcaagtgattgtgaaatgttggtggagaggctaagtacaagaatacattcatggggctcaatgaatctggcatatgcagggagagtgcaactaataaattctgtattgattaatattcattcgtactgggcaacaattttcattctcctcaagaaggtacttaaagacatcacagccatctgtagaaattacttatgggcagggaagagtatagcaaacaaggtgccacttgtggcttgggatcttgtttgtaggccaaaaaaggaaggagaattgggcatacgggagtgcataaaatggaatgaatctgtagtggcgaaatacgtgtagaatatagctaataaggaagataacttattggtgaaatagattaatcatatatatttgaagggagaagactggtggcagcatatgcccccaatagatagttgctggtactggaggaaaatttgtgacatccgtgatatatatggaaatggatacatagaaaatggctggcaatcgaggacagggaagtacacaatcaaggatggctataactggagaagaggaaggccagatcaatggccttggtgcagagaagtatggaacaaaatgaatatccctaaacacaattctatcagctggcttgtgatgaggaagaaattgctgacaaaagagagaacattgcaaatgaatataactgaagatagtgactgcgtcctatgtgaaggaagaccagaatccatagaacatctattctttgaatgcacatactcaagtatgtgcttggctgaagcgttaaaatggcttgggatgaacatacaaaattcgaaagtgacggggatatggagaagggtgaccagaattgcaaaagggaaaattgaaagatcattcatgaaggcagttctggcagcagtcatataccatatatgaagagctaggaatgaagctatatggaggaaaagagtgcctcgaccacaagtgatgctagaacagatcaaacttgcttgtaaatacagatgcctggagataatgaagacgaagaaaaacaaaggaaacatgaaccggttagaaaagttattcagatagcaataggaacatatgtataaagaaaaaacagattgaaatatagggatggcaggaaacagaagaaggataggagacatgaaattgtaaatgtttttttgggatgattaaataaagcttttattttctaccaaaaaaacttgattgctttcattttttgtagtctactttcagtgtatagtctagttaaaaattggcttatttttagattgttgatgtgtgttacatttacaagcttaaataaaattacagtatattttccaattaattttaggatgaaatgaactattttcgtagagtagaatcaatgataaattaaattataaacaagtgaaccaaagatcttctctttagcatgtaccccatttactctcacaactagtctgcttcttcatacctaaaggagccaaaaccccctgacattaccatctcttcaaccgcaaccatttcttcctcacaagagcaggcatctttaatgaagatcgaccaaatctcctacccacaactcattaatgctcagccacctacatcctatctccacaaattaattcttgagctgaataactatgagcttactgctacgaatgactgcactgggccagtcattgatgatgaactagatgctcctgaaggagcaacagattttattcctctgtcagtggaggaaaagcatcgcatatataaaccttgacaatatgctgttattgtcaaggtatccggacgaaaaatcgaacatcaactgcttcgcaataaaatatacacgctttggcagccgacaaaaaatgtgccactgattgatttgggctcggatttctttttacttaaatttcagaaagaagaaaatatgaatcgtccgctccatcagggtccctggttcattatgaatcattatttgtctgtcaggccctgggaacctaaatttatggcatcagaaacaaacatcaaattctctgccatttggcttcgattgccggaactgcctacagaattttatgattttaatatacttcaaaaggtcggcaataaggttggtaaattactaacgatggataattgtacttcagctactataaggggtcgttatgctcgtttgtgtgttgaaatagatctggctaaggcccttaaatcgcatgtttttattggaaatcatcgtcaacaaattttatatgaaggattaagcttattatgccttagctgtgggaaaattggccatactcaaaaaacctgtactgagcagccattgaaggtccttcattcgcaacctaatattcctacagatagttcaacccttttgtctcagccagtgcaaaatgaatggaaaacagtccagttttcaaagaaaaaatccatgatcaaacaccagatacctgtgcatcaaccttctcagcatgcacctgctactccacttccccttctccctttcacacatttagccattacttcgatcaaccctagtcaacacagtcaagtcaatcatattcaaacacctactcccattacactcaaccagtcaacctcttctccccagtcaacctcttctcctcagcatgcaaccagccacgtcttcccacatcacatgccaacatcagccactagccctaatactcatgctgtaatatcgaccatatccaaagttaatgagatttcaaccaaagaagttgactcatctgttattactagccctaagggcacttctcccatgcaatctcatgatgaccccctcctcccttcactaaatgatcacgcttccctaacacatcaatcaccacaacccccactttgttcccccattaatctgcctaagccattagcaccgcctgacctccacaaagctcattcaccacaagttgttacagataatccttcactctctctcaacaatgtacactcccaatctcaatttcttgcgacgccaccaagctccacgcaacgggtctcacaggctggttcaccaccccaatccacactccattccccctcctcaactccagatggatcaacactcgatcatctacactgcacaaactccacatgctccaactcatctagcatcatggctcgagacagggcttcagaaccacgccttgacttgcaccatggtcgtgaatcaacaggaggtgacagtcttgatcaatcatcctcgagacttagcccagatagtgatggagggaatgcagctgggcatggagatctttggccggtatcattgggcaatgactcgctccatccatgtagggccataccatcaacctccattgccaactcccacttgggacccccagaatcttcacccccacatcctacagatgcccttttatccccctccaaacacaacaactccatggatccaaccttactgagatccgccaactccaccaactccaccaacccctcctccatctcccaattcctctcctccccacaaccctccctcacctcctcacagccctccacaagagcagttgaatcacaatcaacacgcagagttagaagcggccatcatctacaacagggagactcgcccagtccacgccttcctcgatgggatcaaagtcttcgtgcagaaagagcaatacgaaagaaagatatatctaaggtgtcctcaaaacctacgcacaacctcctttcgactgcgtccaacaacaaatccagaagttggcaaatatgcgatgttattcatgccgacttttctgttgcaaacgagcagaatcaactcccagagggatcctaggggtagactccagtttgattactcagatagtcacatgaatttcattgtatggaattgcaggggtgtccactcggaggatttcaggagaaatttcaggtctcttttggactacaataatccatctttggtcgtgcttttggaaactcacagtactactcaccagtcaattaaggaggactttaattttactgggctgattgaggtaccagcaataggacaagcgggaggtattgttatactgtggaatgatgaactgcacgtggagcatgtggcctccactggccaagaaattcattgccatgttcaggttctaccaaatacttttacttttcttttttcggctatatatgcaaaccctaatctagtgaataggcatttgctatgggaaaacctaatatgggtgtttgagtcctacaaaggtccttggttagtaggggggacttcaatgatgttttagaagaagctgataaatttggtggtttgcctgttaataattcgcgtgttaataggtttctgcattgtgttaatcactgtcagctaacagatttgggatataaaggtagtcgctttacatggacgaatggtcgtcatgctgctgctaatattttagaaagaatagatcgagtgtttgcaaattatgagttggttaatcattttcctgatttattggttacttatttacctagactgcactctgatcattgtccgttgaaacttgggtttttcagtagcttgtctaggaaattttttttccagatttgagacaatatgggcgtctcatccctcatttccttctttagttactgatgcatggtctcaatatgttcacttaatcccggcaatggatcattttataagctctgtacaaaaatgaaatatttccacgtttggtaacatttttgcaaaaaagaaaaaattactagctagaattacgggccttcaatcatcagttcactatcctactagtctatttttacataatttagaaagcaccttactaaaggaatttcagcttattctaaaattagaagaagaattctggaaacttaaatccagaattgattggctgaatgatggtgacggaaataccaaattcttccatttaagtactctaaataggagacgtgctaatcgcatcacaaatttgcaggacatggggggaaattggataactgaccctcttcaaataaggtcaaatatcagtagttactaccataatttattcagtactagtcaattgatgtccccctttcatcactacattcttccttccaatgtcttaacaaaggatgatcattcgactctgctgcatcctttacaggatgaggaaattttactagctttacactcctttaaacctttaaaggcccctgggccagatggcatgcacccatttttttactaaaaatactgggacgcggttgggaattctgtgaaaaattattgtcatactgtgtttaataacaatcaaattgacccctctataaatcagaccttcatttgcttaatccccaagcataagcaggctgctacaatttaccaatatagacctattagtttgtgtaatactatttacaaattgatcacaaagataattgcaaacaggataaaaccattcctagatcgtttaattcatccaactcaatccagcttcctaaaaaatagacgtgcttcagacaacgctataatcgtacaagaaatcatttcaaaatttcagaggaagaaaggcattaatagtcaaatgcttttaaaattggacctggagaaggcttttgataaactagagtggtccttcatacattacactctgcgggcactcaattttcccggctctattattcaattgatcatgtcttgcatcacaacttcctctatttccttactaattaatggtaatccaacggattattttctgccatctagagacatacgtcaaggcgatcctttatcaccttatttattcatcctatgtctagagatgctttcccgtaggattaatcattcagtggactactgcaaatgggctcccatctcctttaataatcgaggccctaaattgtctcatctcttctttgctgatgacatcatcctcatttcaaaaatcacccataactcccctaaagtaatagtggacgtcctagctgatttcaccactgactcgagacaaagtattaactttaacaagtctagggttttcttctccaaaaatagctctccctctactagaaacacaatcctccaaactttccacatgaaagaaggaactcagtttgggaaatacttaggttttccaatctttattaaaaggcctacaggaaatgattttcaatttctcatagataattttcacactaaattgtctggttggaagacccgctttttaacaaaggctggaagaactactctgattcgttctactttaaattctcttccaaaccacgtcatgcaatttattaagttaccatcccatattcttactatccttaacagaattcaaaggaatttttactgggattctacttctaagaagagaagacttcaccttataaaatgggacactatctctcagcctttagaccaaggaggactaggtattcaaaacttatccatcaaaaatagggctttacacgctagtttagcctggcgcttgtttcataaccctaacctcctatgggctcatcttctactgacaaattatcttaggcctgtccaaagtcctcaaggttatacttcgactatttggaagaacatcatgagaggctggaatgattgtcaccttggtattaagtggaacattggctctggccattttattaaattttggtcggatccttggattactcacaactataaccttcgtactcaaattgctgggcctcttttgcgaagggaggaatcgacaacaatttctacttactattacgataaccattggcatctggagaatctctcctttgttttaccaatgcagttgcaggatctcattcataatgtttacatgtccatccaatctactactgcagaccatctctattggaacctcactactacaggtttgttttctgttaaatccatgtatgctgctgtgcaccttagtctgcaaaatagaaatgtaataaaaaccagctttacatggatttggaaactacctgtacctccaaaaatttcccattttatttggtctgcttgtcataatagacttcctactgcatctttcttaaacaaactaaagatcattaacactagtatttgcccccagtgcaataaatactctgaaactgttctccattttttcttatactgtccagtagcaaaggcattttggcacaatcttaaatttcctgctgcagtgagttctagtaatccggaaacaaataacttattggttttcaaggaactaatttaccagcgtattccttcaaatacttataatgtcccaaacactatcatcattccttttgctctttgggaaatttggaaccatcgaaataaatatgtgtttgaacatagggtggacccattaaacacaaaactagttcttgctaaggcagccgaatttttctatcttacaaatcagaggcataaggaaaaagcaaccctttctttatacattaaatggcaccccccaaatgataactcttataagctaaatatagatggctcctgtttttctcatggtcttaagtgtggaataggtggagtatttcgaaatcacacaggggaatggatcatcggatttgcaggagctaccttgcatggcagtccagttcagactgagcttcttgctttagtcaaaggattacttattgcaaagtcctttaatttaacaccactttgcattgaaacagatgcacaaagtgttattactttgctacaatcaaacttctatcagtacactaatatcttacatgactgcaggtggttacttcttcagctggataggccctgcgtcaataaagtgtaccgcgagcagaaccttgtagcagataagttagcaaagtatggagcccaacaacaacctggtttttgtatgatgtatcaacatccgccatcttttgtgacatcttccatcggccaagaccagcaaggagaaacacgcacaaggctggtcacttcgatatctagtagtaatagattaggttctaggaatgctaatagcaatagttttagggtatctactgtagatagtttgccggcaatgctaggtactagcaacttttgtggtgtagataatgtaaatctgatgcctataatgcatcatctgaactgctctttatgagctttatatatatatatatatatatatatatatatatatatatatatatatatatatatatatatatatatatatatatatatatatatatataagaattattaaattatatataaattaggtaaacattaaagtattttcctttttctttctcatttcccgagataaaaaaaaaggttaaaagaaataaaaaatattcgaggcatgtggcatgattgatcaaatattcaatcaactctctgtacaagttgaaattaaagattaaaaaatttactactacaagattgtacataacaaagcaataatttacataaaagaagcaaaaaaacagacagaataactctgttttttgtcttctatcctgttattctataccattgtcctcttcttcccctttgtaatttagtaatttatttcaaccaaacacaactaattacatttaaatcaacctttggttattgactttacttgctactttcacttattgctaataataaaaaataaaatatagtaatcactaatttctagagaagctttggaagattcctcaatttttttttttgtttttttactttattaattgaaaaatagttggatcaacaactctctgccactgtaattagattgagtacagcacgaaagaagaaagtacggtatacaaattttcaattttattaatttttaaactttataattaaagcttttttcttctcaaacttattgagtaattactatggtacaacacctccccccccnnnnnnnnnnnnncccccccccccccccccccctattttgattcaattcatttttattaagagaatcgtcaagcaaaatttgcgattttagtccttatatattgataaaatttgattttggtccatgtaatatatgtacatttttaaatttcgattaactgaactatgcacttttgacccctcaacttgtaactcttcacaatttcaatgaagtattacccattaaatcatttagctaccatatttgagggtaatataattttgaaataatttaaatgtaatatggtcatatgtaaagagaccaaaacacatgttttaactaataaaagacaaagtatgcttagttatatatgaaaaggataaaaattagaatttactggtaagtagtaacttagggaccaaaatgatattatcctagaatacttaattttgcagttttcttgtagatttaaaggaattttcatccaaccatacttatttatcctagttataggtgagttaactaataatatacataatgaggtcttataatattactagaaacaacaacaacaacaacaactataacaacaacaacaacaacaactataataaaataatattaattttattcctatcttatgctggtaaaaagattgtctcgggaaaattctcagctcaagaagcaattcataacatgtttgaacaaaagaataataatgcagaggccatgtcgaaaatgataaagacaagaacatcaacaacaacaaaataacatagcagtaaaaacactgaaataagagaaacaacagataataatggtaattacatatacaaaaatgaaaacactaatactgatatgggaaaaacggaacaaatacgatgaccgaaactcgatcataatattagtagaagacgtacaaaatttttagtgtacgttagagaatttatattagtaaatatcaaaattaaatgagtttaaataaaacgacatgaagagtgagtatttgtgtagtggactattttttttttaaatttatttctcaccctgtattcggtacccatattggggcccgactaatccggattcgtgctgggaagtcccacattgggggtaaagcgctccttaacaaaggcgactccaaacccagggctcgaactcgagacctctggttaaggatgaaggagtacttaccacttcaccacaatccttgttggccgcctgtcgtattcgtcaacggtcgtggtcgtccaaattctaatggactattttcatattgaggtgaaggtgtaattgttgttgtatacttaatttttatcaattggaaacaccaatacagtacactatttactgcacatggtacatatacttcatttacaaatactcctaattttaattagtagtatacttttttatatagtagtaattactttgtgaagaagtaatcccaatcctactaccaagtgctatgaatcttaaaaagatcaaattgcctttttcccccttttattcaaaatttttttgtttgattttaaaaaaaaattctagtgggtcccagagagaccctttagatctgttttcctcaccactccacaaaaaaatattggccagccatgactttttatgtataatatttttaaggaaaataaaagccacaaagagagaagtaaaaaacaacaaaaatactgaaaaataattgaaaaggtgctttatttatttgaactctgcactttctacacgttacagttaattatttaattaaactcaactctctctctctctctctagttgtttcttttggtctctccattaacctttctttaataaaaattaagagggttaaataaattatttctttaaacttttttaactgaccattaatcattgaaagtgtccaccatatgtcaaaagagtgccagtgcaacagagttataaccaatataagcaaagttccctacactccaatccactgccaaatttgaattaattttttattttttgatttcttatctagcatctgataaacgtattgggcctgattaatcggaattcgagcccgtaagacttttaaaggggaagcactctctatcacggctcgaatcctgaaacttttagttaagagtgaatgaatcgttatatctatcccggctagggctttgcatcggtcagatcggatcggatcggatttagcatatttcagattataaattcggattttgaattttacaaaatacaattcacatccaatctcaattaagttggatcggatttaaagcttgggtcaaataaatatttcggatttttggatcggattgtgcgcctactaacaatctaatcggctactacactttttaaggatattactttttaccattctattaaattgaaaggcaacaagtgtctttcgtagcaatagaaaaaataaaagtttcataccaaaataaaataaattgaaatttcaaacaaatgtgtaataagggagagacgttgtcgtccgccaataggaaggagagactcagaatgagagagacaaagataaaacttaagagaagcggacataacaatttgaagagaggttagagagagaaacacttcgatataaactaaaaaaaaagtctaaagagaggcaaatgaaataagaagacttaacactaaaatttaagttaaatatttataaatgtccatataatttgaatttcggatcagattggattaaaattataccaatccgaatatccgaacttttaaaaaacctaactcatatccgatccgaaaattcaaaattgaaaaatccgaatagagtggatcagttcggattcttggatatccgatccaaatacacaaccctaatcccgccacaagacttggtggtacaatccaaattgatattaactaaaaagttactacacgagaaataattgattactccctccggtccacaataagtgatcagtttgttttaagcatacccattaaggaaatactaaattctagacgaaaatagttagtgtgactaaactacccttcattaaatgttgcaccatagttatagtagcacttacttctcttctcaaatgtaaggagtaaatgactttttaggaatacgtatataagggtaattttggaaaaacaaattgaatttttttcttgattatataaatgaacacttattttagacaaaaataaaaaaataaattgatcacttattgtggaccgaagaaaatatataaaaaaaaatgtaggcgcaattttttttctttttgaaaaaatgattgtaaaatagatgagggagaaaatgcgacttctcaaatcggaaaataaaattttaagtagaaataatgagaagcaattacggtcttaagaaaattagagagaaactctcatccatcactacactgtagcaaatggaaacaccccaaatcaaaccacccctacccccggaaccaccggataagccaagtcaaatggagattgaaacaccaacccaaagctataaggaaacactcttagataaacaaagttgcaaccaagggagctactatgaaatagaaaaccaatctgtcccggaagggctcaaagacaagcacattgaaggggttattcccctaacatcggaagataaagaaaggctttacaaaccatgaaagttctcagtcatcatcaaagtgttcaaaagaaaagtgcctcatcacattctgcgctccaaattaactgaactatggaagccagctgaacagttaatcttgattgacctagactgggacttcttcatagtcaaatttaatctggaggacagtatggtgaaggcactccaccagggaccatggttcatatcaggccacttcctctcagtcagaaaatgggaaccaaaatttatttctcaagaggcaactctaacctccactgctatctggataagacttccacagctccctacagaattctacgacaagtcaatactagagaaggttggaaggaaactgggcaaactcttaaagattgaccaatgcacatcctccacattgagaggaaggtatgcgcgtatttgcatccaagtcccactagaatccccagtggaaacctcagtaatcattggcgatcataaacaagatatcctttaagaaggggaaggaacactatgtacaagttgtgggagaataggatacacaggccaaacatgccccttcaaacaaacccaacatctgcctcaggtaccggaaacctcacaaactcacagccaggaaaatgccacacaagaggaaggccaatggaaaacggttacgttccaaaggagacgcaggaaggggacacaaaaatactatccaagcaaatatgaccattcaaggagaaatcaggatagcaatactccagtgcaaaaccaggtaaacaaccatgaggaacaaccaggtaattccacaacccaaactttttttaaatttaacggacagatccacaatcaaaaggatcaaactagaaactggcggaaaaataagggcccaacctcaaaagaaaggagtggcccaaggtggatacggcacgtgaatagcccaggcccctacggcacccaaaataccgggtccaaaagaaaagcaggcctaaatatcgacgaccccacaagccagtccacacagccccatacaaaaatggggcccaacccaatcattagctccagctctgtgcccaatggggcctccagcacgcctcatcacagggcaggaaaattaggccccaaaacctatgcctcacctaccctctctactgtcacccactctaatggagagaacacaaacggcagcaatggcaatcgagtgccttgcctgcaactccccccaccccccaatattgacaagagcccaaaggtcgccaatgttacatccgccattaatgatcagcaaaaagccctagtcccaacacaatcccacccgtctgcttcccaagatgtaaccatggaggggtttatgatgggaattcaatcatcccctttcattcaaactaataccatttccagtaaatcaaaaaaagccaaaaatgggaaaaaatctgacgccggctgtcattaccactctaccactaccaccggaccaccaaccagcctcctggctggaagcggctctgcaggggctgggaatctcctacgacttcaccatcgagggaaggaagatcactctgatcattcaaaaccaagcacaccttgcacgagtaatagtggaggcactgaacaaggccttggcagcatttgggccactcctctggcaatcgatggccagcacagacagctcgaacccaataatggacccccaagccctaaacagccatctccttcattgctaccaaaccctacctttcttcccggacctgtcaaaggaggacccggcgacggagcccaccttcactctactcccacattcagctccaaccaaagcccagactccacccttgaaatacattcacaaggaaatctccacaacactggagatcctcaaaggcagcaatgtgatggaggaaccggagaagagttacacagtcacagccacagactcaatgctcttggactcggtgagatcaatcgaactaagcaaccaggtgagcgagatcctaattgtgctatgtcccagggcgatgtccaaatgtggattgagcctgaccctagcccacacccaaggtccacccaaacagatcttgaatctaacccctttcctaaacctcaagaggaaatcacctcccccacaagtacccaccttgctgagcccagagagcccaaaagaggcggctccacaagcaccatcacccaaccccctaatgaattacattatttggaatgttagagggggtaatggaatggacttccagaggcactgtaaggagatggttggtttgcacaaaccatctatgcttgttctcttggaaacaaagatggccaatcacttaactctggcccagaccctgggatttgacatgatcatccagtccccatcaattggagcatcaggaggcttagttctaaggtggaaagaagacatggtgattgtggatgaggtggttaccaaccctcaaggaattcatgccatggtgaaggtaaagcctgacaatcccccttggtttttttctgctatatatgctagtaaccaaattgcaaataggaaactgctttgggaacagttgcaagccatagctggcacctccaatgacaactggttcgttggaggagacttcaatgaagtcctgaaagctagggataagtttgggggaaaccctataaacttaaaccgcagtaatttattttggaagtgtatcaataactgcaatcttattgacctagggtataagggtagtaaatacacttggtcaaacaaaaggtacacaatgaggaacaccttaatcttggaaaggatagacagatgctttgcaaatgaagggtggataaagcaacaccctgaggctagtgttctgcatctacctaggacccactcagaccattgccctatgaaaatccaattagaaagccccccagcccaaatccaccccaggtcctttaggtttgaaaccatgtgggctagtcaccctgatttcccaaaggtcattgaccaggccttcaaggggaggcccaatctgcttaactccatagacaacttcaaaatgactgccaccatctggaataaggaagtctttggtaacatcttccaccaaaagaagagactcattgctagaattgatggcatccaaagatccaccagctatcaattcagcaattacctccaaactctggaaaccaatctcaataatggactgaacctcatcctaaaaaatgaagaagatttctagaaactgaaatccagaatcaactggatccaagatggtgatgccaacaccaaattcttccactcttccacccttaacaggagaagaagaaacagaatcctttccctcaaggatgaaaatggcaactggatctctaatcccaaggagattagctcagcagtcactgacttcttctctagcctctacaccacttcaatggctcaagctccatggaaaggacccactacccaccccacgggccccatccttctccaaagccataaaacaatcatggacagaactcccaccagggaggaaataaaaaagttgtcttctccaacaagcctttcaaggctccaggcccagatggcctgcatcctttcttcttccaaaagtactgtgatctggttggtgaaaatgtcactcaattatgcctaaattgtttcaacacatcctcaatggacagaaccgtgaaccaaaccttgatttgcctgatccccaaagttccccaagcaacaatgctgaagaacttcagaccaattggcctctgtaattccatttacaagtctgtcacggagattattgtcagtagaatcaagccctttctcaatcatatcataggacccaatcaagctagcttcctaagtaatagaagggcatgtgataatgctgtcatagtccaggaatacattaatcactttaggaaaatgaagggtagaatgggcaacatgatcctaaagattgatctggaaaaggcctttgatagattggaatggtctttcatcaaggacactctccaatcctttaacttcccagaaagattgtccaatctcatcatatcttgtgtgagctcctcctccatttccatcctgctcaatggaggaaaaactgagcactttaacccctcaagaggcatcagacaaggggacccattgtctccctatctgttcatcctctgtttggagaggctctctagatccatcaaccaagcagtagaccaaagacattgggatccaatcagtataagcaggtcaggacaaaaaatatctcacttttctttgctgatgaccttactctatttgctaaagccaacaccaaaaattgcaatgctattatggcactcctagaagaattcaactcacagtcagggcacaaaatcaacctgtccaaatcaaggattatcttttcctccaatacaagtccaacctcctcccatcacatttcctccaccatatctatcaggcaatccaccacatttgggaaatacctgggcttccctattttccataaaagcaaaactgctacagactttcaattcatcttggacaatatgaactccaaaatggcaggatggaaatcaaaatgccttaacatggcagggagaactgtactggcaaaatcaactctaagcagcatccctagccatgttatgcagtacatcaccctccccaccaagatcaataaccaaattgacaagctccaaagaaactttatctggggcaccaccccagagaaaagaaaaatccacctgctcaagtgggatgttctcaccatgaccaagcaggatgggggtctgggccttcaaaaggcaagcctcaaaaaccaagcatctctagcaagcctggcttggagagcatacaagaacacaaactccctttgggctagagtgctgatccataagcactgcaactcactaaggccaaaccagagacaaagacaaatcaggactcaatgctctcccacttggaagggtattcttaaaggctgggaaacatgcaacaaaggaagcaggtgggtggtccacaaaggggatatggtgaagttcttcactgatagatagatcccaaaccaaccatccctaagagacctcatccaggggcctatgaaccaaaatgataatgatattaaagtagcctcaatgctccatatgggctcatggaacaccactaccctatcctttgaccttcctcagcacaacttagacctcctgaggtctaccttcattccgaacacagccaccaaggacaacctaatatgggacaacacagccaatggctcattctcaactgcctctgcttattccatcctcaatacaccaaatcataaccacccttctcctgagaatgaccttgtcaaagggatatggaaactccatattcccaataaaataaagagcttcttatggctcctgcaccatagaagactgccaactaggagttttctccatgcaattgggctaagctgcccactgctttgccacacttgtggagttgaagaagaggatattgatcatatattctcacattgccccaccacaatccaattctgggattctgtcaaagagaaggcctctactacccttctaacaaactatggaacccacagtttgtcataggctgcaataatagaaaagggtagagatctgaaattcaatgataatctcacctgggcaaatatcctgcccttctgcctgtggcacatttggcttaacagaaatagtaatgtcttcaacaataaaaaagacaaaatcagtgccactaacaccatagtaagggcaacagagtattgtgttttaaatgacagcaagcagcccaaagccaagcaccaacaattgctcaaatggtggcctccatctagggactactttaagctcaacacagatggtgctgcaaagaacaacccaggacttggaggcataggagtagtattcagaaaccataatggagaatggatcctgggctacatggaaaacattccattcatcacaaacacaggagcagaactcagggccatccttaaaggactgcaattggctgagcaaaaaacttactaccactagaaatcaacactgactcagctgaaaccatcagcatgctaataaatggcaatctagcgtttgaccctttgatttgtgaatgcaggttattgattcagaagatgggaagaatagtagtaaagcatgccttcaaggagcaaaatagggtgactgatctattagcaaaacatgcagctggagaagactttttgtgtagatccttattactagcagttcccccggtgtttgccaatgatgtattttgggcagacaccctaggaactgaactatctagatcttttttgggttgtaatataaactctatcatgcaaaatattgcatctttaagggatttaaaatatcccactaactgcaacgacagtgtatgggtagctccctttagctaacttttatatatataaatcgtctagttaaccaaaaaaaaattacggtcttaagagaaggaataagggtatataaagtgaggttgtattattcacgtttataatattagtattattctcgtattctcttacagtaagatcttccttataactgttgtctcttttgctttggttttcatattatcttatctggctgattatcactgtttattattactgtttccttttttatatgtccttgacctgatagtctatcggaaacaatctctttaccttcacaaaatagaggtaaagtctgcgtacataccaccctttccagaactcacttgtggggttatactgaatttattgttattgtataagtgagcgtcattgtattaaattttaactattatatatcttttattatgataagtgcttttaaatgtttgagtttaagtgtttaaccataattttttatagaaaactttaagggttcgagtctaaagctttttatttataagtttcaacaagaaaatttgtaaatattatcgtcatgatagcggaaataactcgtacgaatacgtaaatactaataaagaaaacttagatccactcaactaatgtgacatctctatgagtggagtttcctcatttaaaaaaaaaagattccataaatacacactaacaaagacaaaaaaaaaaaaagagagaatattttattttttttaataaaaataaaagaagaaggagaagaactgaaatggaaaaaatgccaaaaacacaaaggctttcctccctctttcctctaaacagaacaaaaaatgaaataaatagcaaagaacaagaaaaacaaattcaatttttttttttgaaatacttacaatctatctataattagcatctaatgcgaaaaaagatgatactttcagcgccaaaaggctatgagtagaaaaatcattttcaaacgctatagaaaatttgcgtttcttagactttttaaacttaacgaactaaaatatcttaattaatattataaaaaatcaacccctatctaaatagaaaatgatactgtatagccgctgtaaaaataatagcaaaaaaataataatataaaattagttagtgtatatatatatatatatatatatatattttgtatgttaatacaaaaattatacaaattttatatactttttcgactatcagatataaataacttttagcacaggctaaaaatgatagtaatactctaggtcttttcttttcatttcaagtatctacattttgacggatagaatgaatggataattttgatagaagataacaagtaaccaatgaaatagttaaagtacaagtaacttagctcgaatactattgttataaaaatactccacttatcttagtaaaaatagtatgggctagctagttttcgggctggtcattcaaaaatagccagcatttgcaaattcattaaaaaaaccactattttgctgcaacacggaaagttccagcataatatactggagatcggtgcaccttaagaacttccagcatattatgctggaactccaacacgcgaaaagttccagtataatatcggtgcaccggtgctccaatctccagtatattatgctggatcagtatattatactggagttcaagtatattatactggaattctagtatattatactggagaatctttcccgattttgaataatgtttctgttcagatttatctttacatgaaaaatggctaaatttcgatcacttttcaaaatatgactatttttgaattaccacttataaatctggctatttttgaatttctccctcatacttctatagttttttcatttattttcataagaaaggaaacatcagctagtttgacgtttaaggcccggcaaccacccccctacttacccccttaccccctataaccccacccccacacccaccaccccaccagctatttggaaaaggtcaaacagacatgtccattttctttatctttcctcttgcttcctctttactttcctcctattttttctgtctcactttcctcattttcttcttcctttcctttcacctctttattatctcaatgatcataaatttctcattttaagtgaattcaaagagcaaagtcattatcacaatcacattttctccccttagtttctaacttcattttctagtcttgtttcttctatatttagtaacataaacattcactctactccccattttctcaagaaaattcctacccttttcttttcttgtttttccaatggagaagggaaatttatttacaaatgatggtaacactacaatgggcaattatggacttgaaattcaagaaaatgagcaaattcaaaattgttttttaaattccaattgggaaaattctgatccatttgagtctgcattaagttcaatggtatcatctccaaatgccaatattccaaataatagtagtggtgacaattttgtactaagggaattaattggtagattaggtagtatttgtaattcaagagaaatgtcaccaaattccaatatgattaatagtagtagtaacaattcttgttatactactccattaaattctccaccaaaattaaatctttctatgatggggaatttgtcacataatcaattgccacaatttagtgctgatcctggatttgctgaaagagcagcaaaattttcttgttttgctaataaaactttcaagagttttaatgaagctgaattgttgcaacacaatagacaaattgtagcacagccaaatttggaaagtgggaaactttcaagagtttcaagtaatcagtctattaaagtctcatctggatctcaaattcaagaattcaaagatgtgaatttagctacaaaaaattcagaatttggtgattcaagggaaaattcttcagtttctgagcagattccagttggtgaaaatgataccaattcaagaaaaaggaaatcaatttccaagggaaaatccaagaatgctaatgtaatgtacctttcatttcgcctttctgattgcattacttagtgttagtcttgtattttcgcttaggtttttttggttagtttgtttgttattgctccgtccttttctctttcctgagccgaagctccaccgaaaataacttatctgccttcttagacataagggtaatgtctgcttacacactaccctccgaccccattgtaatttcattggatttgctgctgctgcttggaattctaactaacattaattggtaattttttttttttactttgtgtactttatgcaggtttcattagagaaaaatgaatcaaatgctaaaagaggtaagtctgaggaaaataatggaaatgataaagcaaaagaagaggaaaaagctgctaaaaaagaagaagaaaaagctgttccagagccaccaaaggattatattcatgtgagagctagaaggggacaggccacagatgcacatagtctagctgaaagagtatgaaaaaattccaatttttatgttgctcggatcttccaaaaattgctgtctttttgcatgtcggatcctcaaaaactgtgcttttttaaggattcggtaatgtcgcgacggaaaaaaatgatgtctttttgcatgtcagatcctcaaaactcatacttttttgaggattcggtaaggcggcgatagcattttcggaggaatcgagcaacatatattcaaactactcaaatttcatgtttttccatttttttcccaattatgttctctgacatattcttcaatttaacaggtgagaagagagaaaataagtgaaagaatgaagcttctacaagatcttgtaccaggctgcaataaggtactacctttttttttttttttttttttttttttttttttttttttttttttaaattttctctttttgctctgctaaaaaaattcagaattttgatgtgggaaattgaaatttttactataggtgactggaaaagcagtgatgcttgatgagattattaactatgtacaatcacttcaacgccaagttgaggtaaaaaaaaaatgtagtactagtattatgaaattcaaatttcaataataaaatttaaagcaagatttactgaatttatttacttgtttaatgtcatttgcagttcctttcaatgaagttagctactgtaaatccaagaatggactttaatatggaagctcttctttccaaggatgtaagtcaattaaattcttagtattacttcaataaaaaaaagcagttaggtgtactaagctcccgttataggcgggattcggagaaagaccggactataagggtctattgtaaaaaatctaaccctgcatttctgcaagaggctgtttttacggctcgaacgtatgacctctgggtcacttgacagtaactttatcggttacgccaaggctccccttcacttcaccaagaaagcaaaaataaaaaagattttgaatttatgaaattttgtgtttatttttcagatgtttcaatctagaggatcattggcacaaaacatgtattcatcagaaacttcagcacaagcatttccttatggatttcaatctcagccagggcaaaactttcataaaggaacagagtttccatttccaataaactccttgaataataatttggctagaaattcaaatatgcaattgccttctctagatggttatgttgaatctacccctcaggtaataaataattccatttaattcacttatgctgttcggatctttcaaaaatattattgcatctttatcggaatatttggaggatccgatatagttgcagcggcatttttggaggattcgagctatataggaatttattaaagtttgtaaaattctaagtgattttttttttagtagtttgcttaacaaaggtggtttaattggtttttcaggtccccacattctttgaggatgatctcaatagtgttgttcaaatgggctttggccaaaatcagaaccagagttatcatggttagtaaacttgtctcgttatatcgatacaatcagacctctctatagcagtatctctatataacagtcattcaatataaaaaccaagtttttttcgaaaccgatttttgtgttatgttataatatatgtccgttataacagcacgtcactagcagccagaaaatatctgaacaaatgagactgttatagagaggtttgactgttttactagtaggtaaccgatacactatcgtatattggtatatttggacctgttttaataggtaacctgccttatattcatgttattaatctcacggtttatgatagttacttgtagttatcttttagagagaaacagtgtaacatttttccttattgaatgcaggtaatattcctacttcacaaatgaaagttgagctatgaccaaaagagccaaaaattgttgaattcatttgaggccccaaatgagagaggcttctgtacatagagagataattggcaattcagacttattcagagcaaatttggattaaagaagaagaagaagtgaaaaagaagagattttctctctcttccaattcttgatctatttaatgattaattggctgattttgattattattgttactactattttttcttttcctatatggaattcttactaccaaaattggagaggcaattatcatacacctttatggtgttgtgagaactctaccaagatttgtacttgtaaaatataattttagttgcattggtaagaaagtatgttagaagagttgatgaaaatggatatgtaattttttttacatatttcttaccattctaattttttatcactaattcattgaagacaaatttgttacttgtatattattttcttagttatattattgtttgtagctttcttgaaaattgtctttttacacctaaaattctgcgccaattgcggcgagtgttgagtgcatggacattgtcatttgccctacttatccaagctgcaacttgcacgtctctattgttatttgtcattggatcttattactatttgataaacctttggtataatatattttgtatgacggtggtgtttgaatcagctcgtcgcatgtatttttactaattttatttggtaccatctactttgccaattattcatcagaggcggcttaaccccaagctattaacatggctgttttaggcctcacaaaattagaggccccaaaagttattttttttatatgtaatttaaatatttattgtatttattattaaatagtgataataaattttttaaatcatcttttgctatcttgtcaccaatcgttaataatacagtcttatattttatgtcgtcttttttgggagttggtgagaaaattcaaatgaaaatgaaagacaattaaatatgtagttactttctagttctttttacttcaacttgaataaattttaattacaattctaattttatagtatatattttttaaaaatctctgcaggcttcaagctaattagatcgtaaaatatttattatcgttgtaaatgcaaattcctacacgattgttactttgggaggcaatgctatatagtgggttatgttgacggtcatgttaaaaggaaaaaaaattaaacttaataatatcttattaaaggttagtaatgtttcaacaaagattaaaggggttaattacatcgtcaagatgaaattgcatatcaaaaagtaaaaaagaataaacttcaataaaaatatctaaaattattaaacaagtttaaggcatcttattacatcttgactttaagcctccagtactattgaaccgcctctactactcatgcaaggttcataatcaaataccggaatcgttgattctaactattcataaaattcttttttcgtgtgaatcctccaaaggacatattcaaaacttgaggaaccttgtgtattttatttctcgagctgcgaagagaaccccctaaggccctactattcgaatcagaggcggatccagaattttaagaggataggtgcactattgtaaagagtttgatctaaatttacatttgaagtgtttaatattcccttaccatgaacccattacactttagagtttagaaattatatgttcaaaattatattctttttttaaaatttatgattttcacgtattatttatactatgtgccgaaaaataagaccgttagaaatgagatttgaaccgccaattttgttcgtagagatacatctaataatcattgcacgataggagtctttgagcatgggtgcgaacacacatatttaaataatttttaaaaaatataatatttgtatgggtcgaaacttgactcgtgataattaatggggttaactcgctcttaagcctattcgggctaacaaatggcataaccattcgttaataataagcactcgaagttcactcggcttaatcaacgaggccacagcctaatcactattgacgagcgtcccctcaacatgaccacggccgtccaacaccagctggtaaggttcacagctataaatactaagagaaagaaccctaaaaggggggttttgcttcttcttcttcatctctacttctaaaaaagagagaacattattgtaaggctctgaacctctctgaggagaggcagaccaaaccaatatcaaatcaataaaaagcttcccacccttatcatcttaatacataaacatatttcttgtcctttttatttaagtcttttggttgtttattacgatctgctatgattgacccttgtcttactgtgattgatttatgctcataaaatgcacgataactttgagctaaacaatattattatacataatttacgaagagaagaacccatatcctaatagctagatacttttgacgagataatttagacaaatattaggaaaaactaattctacaaaaaagaacatcgttaaatcaagaaaatcatttttcctgtttactgtttttttcattataatctctaaaatttgtgcaaatggtgggaagagaattgaatctagaaatttgacttcatatcattgtctattgaggggtaaaatgataaattcagaagtagttatgctacttatgtttttttttttaaaagaagtgtcataatcaaaaaggaaggggacccttggagcaatataattaagttgtcttcgtgtgacctataagtcacatgttcgaaccgttgaatcgaccatcagagtagattgattatatcatatcccttaagatatcatttttcttcaaacccaacgtgaatgtgttactcgtgcactgggctatctttttttatgtcataatcaactttttttttttatgtcataataaaaaagctaagggaaaaggtgttttttttgggtgtgggggtgggcgtgggggtggggtcaaaataaataaaaatgatttaaaaccttaaatagagtgacttgagggagaaattggattcttattacaaaacagctgttagtggggacaatagtgtctgttaagtccagttgttttgattaagaatgatgttttgttagtgcaattgagctggaatccaaagttccctacttttaagagattaaaccactactaatttgttcacaccttacattattttgatcaaaatttcctatccatcaaaaataacttgtattttttttttttggtttgttggaatttgaattcccacttctatggttttcattctatattataattgttttatgatgtttataaaaacaaaaatgtttattacttaatttataccaatttatgtggtatttttcatttttcgagattcatactatgtgaacttagaccatcgtttgtatttttttcatcaaattgacgtgagaagttgcttatagcattttcgtatagttttttaatattaaaatataatgtaaaaatattgagttgatcttatttattttggctttaaagattaactgaattgacttctgataagcaagacctataaaattgggacggatggagtacttttttttttaacttcactctactccaattagtggattttaaaatataaataaatgataattttgataaatacaggctattaaatgtttttttttattgaagtgtgaaaaactttaaaattgagataacatgaaacaaaatctcatctagtataaccgtgtgaatcgaatgctttaattgatattaagtgaagaagcaactcgatataccctcttccacccaaaagaaacaacaacaacaacaataataataataataataataataataataataataataataataataataataataataaataaataaataaattaccaaaaaaaagaaacaacgttgtaaaaccaggttggcaatggtgaagctctgacttggctaaggaatcagatgatttttcctaaagtattttctgcttagaagacaaagaatggaataagtaaaccgagacatatacttctctttctcaatttatatatcatactttcttctcgtaatttcttatttataaataatttaactttaacctttctattttgcttttaataaaataatttatagtcagaggcggacctacccttagcccttaggattggggtcacccctggtaaaatttcagaaaaatgtatgtatatgaatgcataattgcatataacctaaatagcatgtagtatattttgattgataccctaagattcaaagcgttagcagttacattgctcgatttaggcggcacaacttgatttttaatgtgttgcctaaggtcgattctacttcagcatttgctcaaatttttattcaataatgatactcctgtcacattcaaatcctaggtccaattctacttataactatataaatatctataggatattttagatcaagagtcaatataaattagaacgggtggagtaataaattatttaagaaaaaacagatagaaatatggataacttgaaaacttagtacgtaaaaaagaagataaaactagtggagttcagatgtgtacagattgctttaagaagcagccatgaggataaggaaagtcaaaaaaaaattctccatgagaagctgtcagcaaaatccaacatcttataaaaaccaacaaaaaaatatctgcagccataacttgtttttggaggctgttctaaaatttatttttgaatatttgtaattgattttttatactatatataaaatacttttatttgatcacttatattctttctgatcccaaatattcgtcgtataatgcatttattttaaaatatttgacgtttttctaagaataagcccttcattacttttaaaatatttgaggtttaaggagagataaagattagtgtatacaaatgttctttaattaagattattaagtgggcgcttggacataagaattgcaaaattccaaaaaaaaaaaggtaaaaaatttttcaataaaaaatgatatttgaaaattagacttgtgtttggacatgaatataagtttttgaagttttatgagtggtctgagtgaaaattttgaaaaatagttttttggagtttttcatatttttgaaaattttcaagattcattttcaagtgaaaattgaaaattttatggccaaacactaatttcgaaaaaaaattaaaaaattcttatgtcaaaaagagctctaaatatatttctcatgaaatatgcaaccttttttctagttttcaaacaagttaaaaatcatacttctagagaagatacatgaatcttccttttactagtccttaaaaaagtcaacttggtttggtgaattagaaagattgcgtctatttgttgtatcactttgatcataccaaaccttttaaaatcatgagaggaaaaaaagaagaagaaagaatgatggattttgactgcatgaagagatgcttaatcatagcatttccataattaactccggacataacgaacaattagggtccactaatgaaagtgatagtttgagggagattgattgaatatgttattttcttttgggatagttgagattattgatcaaccaattaattattattttaaatgtttaatcggatgttcgatatctgtattgggattccaatcaattgattttcgagatagcgtagtgggattttggggaaattaagtagtgacattagcatactaatttcatgccggaagcacgtgcgtatacaatgtagagactagggatagctttcgctcatacactatatttttacctaaaaactattgagaatatatacaaataattaatgttgaattcattaaattagatgagatatggtataattgcaaatatgaacccataaagtttaaattttagaaccgcctcagtctgcaagtgttgtacattatgctgcaagtgttgtacattatgctgcaagtgttgtacgttgatcgggcaaggtaagaatataaaagacttcatcaattgcgacaaaacgagattactcgaccgtgagagagtatagactatagagtgatttacttgaagcaaagagtgacagtctctacaaaaacaattcttgaaatttcattcagctcataacaatcaccttatataattcttactattgtttatcttagaataatttgtgtactttaaagtttaatccctttataattagtaagttaattaaacaactcaaattattagtactttggattatcaagtctttgttgtgtggttggaagaggggtccaattaccaggctgtcaatcttcaacatcatgctgtatatatcataccttccattcactttatgtctctttctttcaacttaagcagcaaattttctctgatatcgtttggtatgatattaagtagggaagaggcataagtacccttgatatagccggagttttaactatacattttatttttgcggaggtcctagtactctccccgaactgattagaagtagaattattgtgattctttggaggccagaatttaaactttatgaattttgaattgcgcaacgacggctttaaatactaataactgaattataaaatttaaagtttatcatatttagtgaattttataatatattacaggacttaaaacacatttagtaaaatcggtcgatccataacttatcttctagcttcgcctctggaccccaagtgagaagaaaaagcaggttgtgattttgaagattgaataaccagcaccatcattttgctttcaccaactagatcttttactttcatttcttcaatcaattgtaatctctaaagaatatctgaatatttctacttaatgtctatatcaagaggtacatagatttggattatagcaaagatttgcgtcttgtcaaagtaatcttgcttaagattaatttattaaagcacatagtactaatctttaaagcatatcttactctaacaagacattagtacgccattgacaatgtcattattgagtttgattttgtaaatcatgtaataatcaaatatcaaaaaatgccataccaacatctttttcttttttttaaataactactcagacaatgttgcacggttcgagaagtggttgataatggatctgcccctctaccccctctccacttgaataacgggcttttatctataacatgatttaaactcgtaatatatgttttacactcttattgctagacctaagccatgagggcaaatgtagtacctatatttaatttgactttatttaataatgaagcagaaagtagacagtatttttttttcttcctatttggtaaattggaaataagaaaaatatttatagccacagaaaaacagtctctttctattttaatttctattttcttttttgcaaagatttgtttctttcattgggccaaatgagatattgtagttactaaacagtgtatctttaatggaccacaaagagaaccaaaacttgccccatgttactgttccatttccctttcatgatcaaaatggtaggtttcatttacatgtcattttcatcatcatttgccccattgattttctttaaagatggtgtctatcccttcctataataaaggagaaatatggatatatgtcaaattcttgggtaattttaaagtctcatacatgggttaaaaaggtataatttgtagcgagttctcatgaggagtaagatccctcaactctttgcaacactaatatttgtgcttttcaaaggcagtatatgacttgcgctcgaacaactcggtaaactgaacctgctcttgggatgggaaacgcatttaccctttgatgtgataactcgtgtttctcgaaaaaaaaaattaaaaataattttagaaggtaatttcttcctatctatttgaatcttaatcacagagttatttgataagcatctacccagtgaaataggggagtcatgcccaagttactgcaaataatggtggagcttagtacacggggttcgttcggtgaatccagtattttgcttggatcttatactttattaggaaatccattgaatatgtataaatgcttatccccaacccaataactgaaacgagctataatttgatgacaaattcaaacccatagacttctaatcttggttccacctctcaactcaaaaaacattgttataaaaaagaaaattatgggatccacatctcaattccatgattaatatatggctagggtatgagcctacatggtatcttttcttatcttttgtatttaagtgaaaaagaagtgtctgtgcaaaaaagagagaaagaaatggtccacaagtagggagagttacatgtcagagaagacaatcccacaagctacttgtttaatggttccttgacaggatagactacaatatcaacaaagctgccaaagttttcacaagtactaatggactgtctgttcttggcttcaaatacttgcacaaaaatgcaatggcatactagtctgagccacttgaagattgccccctatccacttgacaccaaaaccaagcaaataaatgatctaagctactagtaaacatccatgttccttcttggtatctttctacagttcctattgtctctacttctgggtcctaccctatccaaataatgcacagtccaaacttttcgaaaattaaataaaaaaatataatctcactttaccacatttcgtaccttgtatatggtgatgatatgagtagagcttaagtgaagatgtgaggattcatttcgtcgatctcccacttgtttgggattgagacgttaattttcaacacctacataaacatataatttttaatgtcttgtaaggataaatatatataaaaaaaatgcttgattctcactttccttgatgcatccattgaaaacaggataaaatagtaggagtacaaggtatgaatccttaataaaattgtagaaactttgatagagattgaaatatacctttgttggaggcttgaatccgacacttgtaccaagtccaaattagtcacaagcagtatgccagagcatgttgagatctgaaattaaaaagtaagaacaagaacttgggcaaaacaaatcatttttttcattcccattgggcaattttagaaattggatacaaagagcttgaatgatccaataagttggttttttcacaattggcgatacaattcctatcattgaaatttgaagagaaaagctacacctttccaaaaccatatcatataacactattattggtacatacaacacaccacctttacatcaaacatttcctagtctatatgttgcatctgtcatatcctgagaaccaagaagatggctctcctaaatttgtcaagtcctcttctctattgtagattgacttgaattcttctgtccactgcttatcaccgacgttattcacctcccctacttcatatgttgctgtcgcggaattatcatatgcggattctgatctttctttaggttgagatgatacttcaagtatctgattcaaattgttgatctccctttcatgtttcttcttcagtttatcaatctgtttgtaagccgcattagcttcttgctctgcttcaatggctcgtttctgcataacattaaaacttataagataactctggccaaaagtacatatccaagcaagagtaacgtgcttcagggcaaccaaataacgacatataagctgtttcaatttctcatgatacatcatgaaaaagcaaggttcaaaatatttgtcatagaaaaatcacatacaacatgattaaatattgtaacaccaatagctcaagctaacatagccaatctcttcagtggatgcactacatcattcactgtcaatgactgcacttccttctggagaaccaagtaatcaaacataaaacagatccaaatgcttatctgacatagctgtaatatattcaagaaaagcacggaaagaaataaatactgtaaaaagagtttgtaagagatcaaacaataaaaacattctatgtaatcagatgaaatgtcaagttacgtattgatcgaaaacctttggagcattttcccatccataatcttaattcttaacaacagaattcctacaaatagatctaacattttttttttgatttgcactgggtgtccaagtctctatgagccccgactaatcccgggggtgcacaggccctcggcaaggagtttcccgcaagttcaccacggttaattcaggttttacccagtccgatggctctcaaaaattatttgcacccagtgagttttgaacttgagaccttgaaaagggagcaaaccccaacgctcaagtcaattgccaccaggccaacccctgagggttacaaatagatctaacatatgcagccttacggaaaagaataaacaaaaaggacacataagcttcttctgaaacgtgatgtcagctcaagaaaatcatgtatcctgtgtcgaaatgtaaatcaagaaggtaatatgtgtattaaaatacttaactttaaatagagctagttggattggcttatgaatcatctgcattcattttgccctgtttgggctctcattcattttaatacaaactaattgtctttaaagaaaaattggcaatcctctaaaattggcactagtgggatgtcataatctgtagtagtagttcatcaaattgcttaattctaaaataatagcatactctttgtttgatatgatcccactgtacttatcgatatacatagagattcatcaactttatttcaactctctaacaatcctgatctatttgaaatgcttaggttctctacatctctaactagactacagaaactcctagagtaagtttaaaaacagcaagtttgacccccccaaaaataaaaaggtttaaaaacagctaaactaatcccaactagcctggtatcacctatatggatcatttattcccttttttcatgttcttagcttatttatactttgaaaagaaaaatgactagacaaacaaattaatactacacattacacgtcattcaataagatgtggcattggtcacagattacgtggcacatagtaaaaagtcaaataagcatgccaaaatctgaagaacgaggaagagtggcatctgttcagataagacaatatgaaattttccttattatgggaagaaggcagtaagattgattataagaaaggtttccttgttatgagacaaaagcagaatctctctgcaggttagttcaaatactcgttaacctcacctacatgacgagccttgaattacagggatacaattacgcaaaagcattcaaaacgccagactcttaagctagctaatccagccagcaagccataaaagaaaggggaaaattagtaaaggttccccgcgcgaaactaactcttctaaaacctaatggggaaggagaaaaaaaggaaggactagctattcgattgatttactttttattaccccgtctgctctcttgttcatatattggtttttagattagattccccgtatgctctagcatagagaaaggtagacttcttttctctatactagtaagagagattgaacctgcaagcgatagcctaacagaaaaaatttatgtagaaaattagaaaaagaaagtaaaagaaaaggatgggagcagaggtggagacatagacatataggatacataatgatgcaaggagtagcataatgagtagttgactgtacatgacctcgaaagcaagctatagtgctgcaatgatgagaaaatacatgctgataaaataaagtgcaactaggaaatgaatgattccaagaactcacctcagcggctgcaatagcttcttctgcctctttaagccgcacaagcaattcaccagccgcttgtacagcttcagcagtatccctcagttgagcctgaagccccttattttcatccctaaacattcgcctctccttttccctttcgacttttagagctgaaatttctgcagcaagagcattgataaatttggattcagcacccctgactcctgcctttgcagctgctttcttgacatcctctacaccatcttggatcttcctatgcctgataagcaattgcatatgtttctcctcgagttcagcatactgttcaagcatgcgtgcatgtccctgcattgccatctgcattgcttcttttagctcttccgagcacttcttctccaaatctagttcttgtttatgcttttccgccatgctgcggctagcatctaagtctaacctcaattcttctacaagagaaatccacttactttctgtttcagcccattgaatcctctctctttcaagtctctgttcagcactcacctcagttgactctagaatagtggataaaggcgaaggctcacttgactcagatggataagttaattgcagaggtgaatttcctttcttggatgactttgatgaaaaatctacataaaactggagctggcttctcaaatcctgaatctcctccagcaaaacttccctctcacctaagtcaaagaagttacgataccgttccagttcatcttgaactcttcttaattcaattttcgtacttaaaatttctggatgattttcatatttctccttcagaagctgaaaacgatgagttagatatgtatagcaggaggagaaattgtagattagccaaagttcaagtcagacatataccttatgctcatgagtgagtgataacagttcatcctccatgaactcgtctgctggtaggattccatccattaagctctcaaggcgaacaatcttatcctcccgtgtttggccaataatggcgttgcattctcgctcaagtttgtattgttgaatctgccattgtttgcaagacatgttcaacatcagaaggaaataatgaaagtagaaagttgcacaattgaccaatcaaacctaccaagcggttgagttgcatgatctcagaagtttgcttggcacatatttcttccagtgccatctctctccgtattgctcctgccaataccttttctactgcctgtaaacaaagaaaatattgcacatgaataagaactttagagatttacaaaagccaaaaattcataaactcttcaaacttactttgggtacttgaatcttgaacttttcgcaggactgtgatccatcagcaggtaccaactgtgatccatcaactggtaccaactgcatgtttgagtcattgttggcatctttaagctcttgctgggagtttcttgccttacatttaccacacaaaaatattgaatctctaatacttgtttggatgcccacatctgctttagcaactggtataattgctctaatatcagcaggtttgcaagaaaatctgaatgaggaccgcctcaaagatgtactttggtgattacttataatttcaagtcccctatgtagactagcagccaaatgctcagtcgacgtgaaacaacttttacttctctgattaggttgagagttcaaacaaatactgttagaaggctttgcaaaggacaaatgtggtgcgtccaacttactctctctaagatccttctgagaagcactcagcatcgatgatgtcctaagacttttcctactgctattaactcttggtgaaacgcttggagtgggtgactttaaaatgggagatttatcatttgtaactatgctaaggtccgtacaagctgcatcaccatccaagcatttagaagagttttcaggagttctttcattgtagtcttcacattgctctgaggctgtttcttctaccagttccctttttactccatgatgcaaattaatggccagcgatggaagacactctacttcaataggctctcgagaaagatcactatcaagcctcttcgacatggatttcttcaaagcggcctcaacattttctacagccatggaacagttatccaagttcctcaccccagcacaatcaataactttgttttcaggttggacatgttcagatacctcttcctccatggtaacgtctgtatcctcggaaccttcctctctcttggctgtgttctccttttcttcgtcatgtccttcaggagcaacaaccaaggaattcctggaaagagtttttcgcaagattccaatctctttacttccttctggtaagagacctaatagttcggcttcctcaacaatttccatttctgtgtcaccatcatcatctattggacgtttgaggctgaatttcaaaagatttaagcttctacgcgcattccaccctgatgaataatttccattttgatctgcttgagagccgttggccttcactcttatcagctcatcctgtaaagaggaaggaaaataaggcgttcattcaaccaagacgcatagttcattcaaccaagacgcataagcaaggactacgccgatcgttaagatagatattaacaacagaaggatttaagtgtttgcctttaactgtcgtataacttccctcaagacatttacatcatcctgcatttcctcattgacaactgccttattcttgattgcctttgcgcgttgggcaaatctcagggtactgaaagtctcgctcttacaactgcattaccaaataaaagaccgtaaaaattatcaacaattaaataaaataaattgaaatgtaaactttacgtgaatgaaatacaaataaggaaagtacgtcctgacgctacctcggggctggagaaatggcacatatcattgcaagttttgcatttccaccaagagattcctgtaacaaaaaagtcaacttggaatctctatagggaatgtgccgatgctttcctgtttgggaaacttctgctagaatgtttatcaagttcctgtagatctcaaaaaaaagtgtaatcagaaccaaatgtgaaaaatttaacctaaaacaagaagacagaaggaaaagatgaaaaattacaaatttgacaccctacatgaggcaaaaataataattcctgaacagtcttacatgaaaacgaagcttcttatttcactattttgcaattctacaaataagggaaacggtgttcacgcaatcctgtataactttggcaggatatagaaaggaacagaaatagtcaacccagccttataatgacttctagttataggagaaaaaacagtaacaatcagtcaggcacccactctgttacacacaatttgagatttaataagatttatatatttactttactggcaacactctctgacatcaatgaatatgtcatgcactcgctctagaggatcctgctcatgttcattgataacaggtctcaaatgttcagattccaggaagctactattagacacggactttttctagcaaccccttcttgaagaatgtctttcacttgagattaaaggcgaactcttttccccgtcaacaatgtacataatcgcaccaggaaagcaaacaactaccagaaagacaaaaggatccctagatggatcaattcaatggtgctgactcttcttgaaccaaaagataaaggaaattttcatatggtgccaaggccaagattgctgaatgaagtaaaatatgttacatctttaaatggaccaatcctttcttcttcattcaattagctaatgagaaatatgaaatgtgtgtttatggacagtagatgaaatagctatcttttttatggccaaacaacagagaatttgcaacttaagaaaataccccagctgtgacagggagcgattgatgttcccagcttccttcaggcgatctccagctgcaccagttagcttttgcctttctgacccggcaagatctacgagatttatcctacttgacttcaggcagcttaagccatcggccatcctctgagaataaaattttatataagatcaacagagaaacattttcaaatctcaaatacaacagactactatgaattatagcaagtttttctaagcactgtcacagacacctcaatatgtaaaagttactttacaaccaaaaatgacaaagaacagaccatgcataatttagtcgttggtatttttaatagagattagatttgttgtaataaagaaacgtaaaaggtctagaggatcgttataaatcagatgatagtcacaaggacacaagaatctattaccttgcatcgtgattcaacaacacaagtaaatacactgtgagaacgtgaactctcagcgtttatactagtagcgccagttctcctgtttgacaagccctgcaatattcattgagcaagttccattagcttcctctatgtacatcaggccattttcataaggctactcccaaaatacaagtaaaagaagtagagatgtcacttgctacataactgacttaacaaatacacaggtcgaaacctagaggatgacgacaaatcaaaatatgttatcctctcctatttaatgtgaagcataaaacattgaaatagggaaaaaaaaagataacaacaaactgcagccctaagctctgcccataggaaaaaaaagaagataacaacaaaaggcacgagcgttagttagggaaattaagactttttcccttcctcttttaggaaatcacaacaatgaaaaacagtggagtaagagaagccctagggctctgcccattgttccaaactagaagataagatcaagtttctttcaaatacatggacatttcaatatgtcaaggaactgaggaataaaaatatagttgcgtttcataaaaaaccacacatatccgtagctaaacaggtttttgtttcttatctattccatgataaggtttcatagaattccatttagtaatctcatctttcaatggtggtgcagccacctcacgaactgctaacatttactgcacaacagttgtcgtttcgtttctataaaaacctagacatgaatgcattattcttctgtctaataaaatgtaattaaaaaggctgcagtctgaaccttcatcaaaagctttgtcacatccttcatggtagaaacacattcctcggtcaaattttcaacatagacaccagtcctcacatcttccctaatctgaaaagtgaagccaattaaagattattaatatgaatttctcagaaatgagatgatgaatgcaatatgttgtagtttccttctaaataatccatcattatatgttagttccttctacctggaggtttcgttgactaggatccaacaaatcagtgatttgctcattgtatatctgcaagttatgggacttaaagaacttagaagagttatgtaatgacctttcacatattgcaaaagaatcatccagattgcctaacctcaagaaaagagcatctacattgatacacgagctgcttgtcagaatgcttaatttgctcctgaaaagaaaatgaattgatactcaatacttatacaacctacagtacatatgggaaaagcaacattcatataataagagagacaacagaatatcacctcctcaattcgttcaaaaagtcgttggaaaacacgtggtgttaagccttgttgatcacttgccaagttttcttccaacaatgcgttagctggtccccatattgtatatgtctttccactaccagtctgattaaggggacatgtcagcaaaaaaagattacagtaaaatatttggcatcctggagtttatatttagcatatcgcataatatgaggctaaagttacctgcccgtaagcgaatactgagctgttaaatccagcaaggcaattttcaacaagaggagctcccacaagctgaaatatatctagctgcaagagcaatgccaaagcagaaccaatcacatttagttgatatctctcaccgagcacactaatcaaattcaaatatatcaagcgcaaacataaaaaaaataagaatcaagcacgtttgtttaaatttttatgcattacttgtcaaatttatctcctctacaagtaaaacattatgtttacctgtgttgattgggtgtcagcaatagagtcaaatgtaaaagtatgtcccgatattgacaaagaatcattagagaccttctggagaacagtttcaccctcttcctcatccttgattggtggcctcatcctcactataacctgatttgcacggaaaacattgcaacaaagtcattccaggatctaccataactaccataagctctcagattaaactactttgcacaaacaaaacagtaaatttttcagcaaatatgttcagcaggatcaatatttcgactaataaaattcatccttccatcacatcgaaatattggactcaactaaagtaccacacaattgatgacattcagtttaataaaaatttcatcataagtaacaaaaaagttaattttcaattaaaaaaaaaaggcaaacaaactgaaattcacattttcaataaattcagagcaatttttcgtaaattcacctcagatttcgcaataagactgttcaatcaaatcgaaaattcatgaacaaaaaagttaattttcaagaaattccttcaccagaaacaacatttcgcggaaaagtcaaccaacattcatctatttaaaaatatcagatgtaatgacaattcagattaataaaaaaatcattaaaatcaagaaggatcaattaattttcaagcaaaaataaaacctgaaattcacattctcaataaagtcagaacaataaattttctagaaattactttgacgccagagtcagaagatccagcagcaacggtggcaccgttctccgattcaacactgagcttccgctttaaaggattggaattagggtgccgaggcggtaacggactcttcatctttaacacaccggtaacagccggtgaggaattcagatctaaattgggattagcattctctttagacgacgacttgttcttccggtacggcggtggcgtcagccatttctgctgctgctgcttcgtagtagagctagggtttggactcgccggcagcatcgcttcgtgattctcccttaagattgtgcttcttggttgttgtacgttgtgcttcatcgttagtacatgagaaaaatggtggattttagggatatggttagagaagagagaagagaatgaaaagaaaagaaactagccgttgaagagatgatgagatttgaatttgaaataggggaaagaagaagaggtaaaaagtgctgggaattatccaagccgttgattatgatcatacggttgtaaatgtaggattcgaaccggaaatgaatatattaaaaataggagtttgaaaagtgataattaaaatgtattggatctagaagtggaagaagacaaaagttaaagagagcgtctttttaaagagggaaattttagaaaaggtgttgtttggttatatcttgatgatggatagtcaaaattacatatatcgtacaactaagtcaaatactatggttttatttttaacaacaacaacaacaactatccaatatagtcccacaaagcggggtctggggagggtaatatgtagacatgccttacccctacccgaaagggcagagagactgtttccaatcgactctcggctcaggggggaaaggaaaaacaaaaacaaaaacaaaagaaaagagcattagtaactccagcagaagtcgcataaataattatctaaacataagaaccataaataaagtggcgtgcaaaaataacaaacaataactaccataaataactaccataaggagacacaatccaatacacaaatcatctatgggaagcactaccaagcctcacccaaccccgggaaaggagtacggaaaattctagaagcccctatcctacaaccctgatactagacctccaaactttcttatcaagggccatgtcctcggaaatccgcattttagccatatcctgccttatcacctctccccaatacctcttaggcctccctctgcctcgcctcacgccgaccaccgccagccgctcacaactcctcaccggggtatcaaggcttctcctccgcacatgcccgaaccacctgagcctcgcttctcgcatcttctcatccactggggccacccccaccttctctcgaataacttcattcttaatcttatctaacctagtgagcccgcacatccacctgagcatcctcatctccgcaaccttcattctctgaacatgagagttcttcaccggccagcactccgcgccatacaacatgacaggtctaaccacagctctatagaacttccccttgagtttctgtggcacttaattgtcacacaggactcctgatgcaagcctccacttcgaccaccccgcccctatacggtgggtgacatccccgtctatctctccatccccctgaatcaccgacccaagatatctgaaactgtccttcttggcgatgacctgagatccaatcttcacgtccctgccgacttcgctcggctcgacgctaaacttacactccagatattctgtcttagacctgctaagtttgaaacccttagactcgagtatggttttatttttaagtttatactatatatagtgacaatatttatataatgacatgtgttttatataattttttataacaattaaaattatactgatagtattatattttacattgacatagatcgtgttatacatttaaaaatcaaatgttttaatcctttggctctttgctctttatttaactgttgttggtgaatgcatacaggttgtttgataaaatgtccttgtaagttttatacaaaaacctcatacctctgaaaactttagagctcgtttggccaaaaaaaaaattactattttttttttgaaatcactatttaaccataatttttcaaaaaagaggaaaaaatattttatgtccaaacgggcaatgtgtcaacattatttattttcattattttacaagactaatctgtatatcttttcttatttgttttttttttaatttcgaaaaaaaaaactgactatttttccaaaaaaaaaaggaaaaatatttttatgtccaaacgtgttcttaatgtgtctgtatcagtttttttcattattttgcaagactaatctgtatatcttttcttaccagagtatttgttacatagaaaactaacaaacagaaagaacaacataagaaatgaaacccttccaatttaaccttctttcaaataaaaattgcaatattgttaacatcatctaccaatcaaccgtatctaatcctaattatcagtctcggcctcagtaaggctagaaaattcatcgatcctagtattgtggctatctgccaaaactggccacaactcaaagacattccttagcactatcagaatgctgcaaataattgctgccagccatgtctgccatccacacttataatccctcaaagaaaggccaaccgtaacggcaaacagcaagttaaaaatcccaaagtcactagtcactggcttaattagcatgggtaaaaaacacagaaactgttgaaccaagaagaaacatatgtattaataggccaatggattcttggctgtttactatcattcccacccacagtcccacaaatggtccaacatttttgaatgcacgagcatatttagacacaataactgtacttcttgacttgacgatatcaacatactttttttgtagttattgagagagtaacagtagaattactggaaaaagcatgagaccacctatagtgcagcaactcactctagcttttccaaccacattatatgaaccttcccaaagcaaaagtatcgcggaaataacataagcaagcaaaaagagagcatgccacatcttctgttcaagattcatcttgctaaaaatgcaataacaaaatgagacttgaagagaaataatgtgtgtttgtcttaatattttttttcttttctcagaataggtttatttatagacataccatacgcttttgattaagcaaaaaatacataatattcctgcccgcacaatgaaaggaatgactacaaaataaaaattacaccttaatttgggctattatggctattcttacccgggcaatgaaaggaatgactacaaaaaaaaaattacacgttaatttgggcttatggctattcctacccgggcaatgaaaggaatgactacaaaaaacaaaaaaaaaacacgttaactatggctattcctagtttcctactccgggcaatgaaaggaatggctacaaaataaaaattactacacgttaattgggatctttttcgtcaaggtagttgaatttaatctattattattattattattatttttttaaaaataaataaattagtcagacattttgcagtttttctctaatactacttctacacagttgtttatccccctcctccataagcaaattttcagtctttaaaccctaaaagaacagataaaagtttaaaacaaaaaatccaacctttggttcctggtttttgcaatttgtttaacatgatttaatttctattaaaaaaataaatattcgaaagtggtatgattggttgtgctttctgatgaccctttgaagttttttagtctaatcagtaactatatctttactagtgtttaaggtagtgttatgaagttgataaatctgtcttattgtgtgaatattttatgatcatttgatatctctggcctactaattattaatttgttgtatattgttgatgttgatagctagccccttatattcaacttcttttgccaaattgccatctgcattttttcttttttaattctcctttgttatcttttctttagttttcttgtattgttatttcttgccattgctgcttcttacatcggttttccggaaatagctctctacccttccccagatccgacttgtgggaatacactgggatttctctttttgtagttgttagtgaaaaaacagctgcttcaacatatccttctccttaattttttccctttcttgtaagacagcaaaatataaatcaatacatgaaatctatctgcagccagatgggtgatgctatccctctaggtgcctctccgtttggcaatgcgacggtttgctatcagatgggcacgcagagcttgaatatcgtggtttcaatttacaagaagattaggcttccagaagcatttggcggtaaatcagatggtaagtcttttcacctaaagattgtgtttcttgacttgaaattatgtggtttaatcctagaaatctgtcacatacgaacatatgataattcacgtgtacttaataagtatcaagtctatccctaacgaggtagtggacgtaccatgaatattcctaggatctttcaaatttggtacataacagtaattttctggtgctttttgagatggaatccatttgtatatgatgcttgataccggaatcaactaaagtagggtgtacaaacacttttagactagcggattattggacaaatttcatatgtcagaaagaagctgaacttaaggaatgtatacataatgtaataagttggacaatgtagtcagtgtgtcaaaatcttgtcattgatattgccataaatttatgaatattcgtgggagaggatataattataatgtttttctagcttggatggcagaacaatgccacgacttctttgctgatatagtttggagacgagaagttacttcttttagactttataagtggtgttttttattgcaagttaccctctccaattgtgcttgttcatggccttggtgtgcttgattttgtgttttcataactttctttgagatactgaatatgttcttctcgtgtttatttcagggggtcttgtaaggcttaaagacatatggtggcttagtaatagttacttttccttctgttgtatagtcgctgccctcctgaatttcgaacatgatttgggaatttttgtgacgacccaaaggggtcatcaccgtaaattcttctttttctgtgcttccgaggtctcaaaaacctctcgtggggttgcttcgatttgcgtacgcagttcggacgcgaagccgaaaagtttttatattgctaaacttgagttatatgtttaaaatgataattttaagtataataatgatatggttgacttcggtcaacattttgggtaaacgaacccggacccggacccgtgatttgacggtctcggaaagtccgtaggaaaatatgggacttgggttgtcacgaccccaaatccataacacgtcatgagggcgcccaacaaccttgccgggcaagccaaatgcggaaaactcaatcaagaatttaacgacactcacatccagaaaggggaataacatcccaaaggggtttccagaaccaaatagagcaataatgcaaacataacgttattacaacccaaaataaaacatgtctgctaagtgcgcgtgccaagacctggtgtcatagtatacaggcatctaaataagaatatacaacacaccctgactgtctggaaataaggacaaagacagcaaaaggaatacaagagagactccatttggctgctggacgatgaagagatgggaagcaactcaccgtggaagtctaaccgctgcttactggcgcacaccctgatgatatccagatgaatcagcctcagaccctgtacatttaagtacagaagcgtaacatgagtacataaacaacatgtattcagtgagtatcccgcctaatctcggagaagtagagacgagaggtcgacttatactcactaaggtcaaaatatataatgaaagtgacttaccataagcagttatatcacagagtataaagcactaaacatggatagtaatacttcctctttttacccttttataagcagaactcagttacataactataagggtcaatgataataaaaccaggaatataatgcgcaagtagatgaaaataaacatacgcaattaaccaccgacgaacgtacgacccgatcgaacagaaatataaactgtgcactgccgagggtcgaacggcccgaaccaatagatgcatctattaccccactcgcaaatcttgtgcaacgcgatgaaccgaaagtaaacacataaccccgctcgcaaatcctgtgcgatgcggtgaacagaaactaaacacatatttaaatcgtcaggtaatgatgaccaaagaggcataccctttccttttaacagtaggcaagtatagctaacaaggttacagtttattcacaccaggccaacagtggcaccaacaacataattatcacttgaagcatgctcatggtcctaatctacccggacattggcatacaagtcactacgcacggactctcgtcaccttggtacgtacgtagtccccgcatacaagcaaattcttatttagtcattaagtcctatggggacaattccctcttacaagattagaaaggagactcacctcgctcaaattacacttccgaatagcaaacataagccagaacctcaaacgaagccgaaagcgcacaaactagccaaacaatataggaactagtcaataaagattcacaacgttgatttctagccatttaagtgatttaccaaactttcccgcaagttttctatatttcgaccccgggcccacgtgcccggattccgatatttttcgaaggaaaatattctctatagcctaagggttactaatatgtagattttagttcattacatagctaattaggtgattagatcgtagtttttaccaaaaccctaggtctagctctaacccttgatttttatttgattattggtattaaatctaggttataatcatctagttaatcttggagggagtggggattacttaccttgtgaagaagtgaagaaaccctctctttggaatctctaaaatcgccccaactgaagtgtataaatgaaatgaaggctagaatcccgcttttaaagaccctacccaggccccgggtgtcgcatttgcgacaaaaatctcgcaaatgcgaacacccataatttttccctcacttcgcaaatgcgaaccaggacctcacatttgcgagtcctggcctgacctgcatcagttcgcaaaagcgaacaccatgtcgcaattgcgacccccaccccatacctgccttgttcgcaaaagcgaactaaatctcgcaaatgcgagtctcgcccagccagggccaagttcggaaatgcgaaatcaacctcgcaaatgcgaggtcagccccagccatgccaagttcgcaattgcgaacctgacctcggaaatgcgaacattgcagcagcagcaaaaacaccagcaactgctgctgtgtttttgcacaacacgcatcgatccgaacctcacccgagctcgcggggctccactccgaacacccatgcaagtcctataacctcatgcaaatctatccaagcaataaaatccttaattaacacccaagaacacggatttgacacccaaaatgcatgaattccttcaaaaacacttagaattctatatttccagtcgggtgtccgaatcacgtcaaatcagtcccgtttcacgccaaatttcacagacaggacccaaataccaactcaaacttgtaccgggctccgggaccaatatatgggcccaataccaatatggtcaagttttggcgaacttccaagttattaacttccaccaacgggtccaagcgaccctaaactatccggattgacaccaaaccttacgggtaaatcatatatattatttcggacctgtaccaagtttcggaaccggaatccgaacccgatacctaggtttttaacaattaaatatattaattaattctctgaaactgaagattaataattttacacaaaaattcattactcgggctagggacctcggaatttgattccgggcatacgcccaggtcccatattttcccacggacctcccgagaccgtcaaatcacgaatctgggtccgtttcccaagaaagttgaccgaagtcaattctaaccttttaaagaaaaccttaaggaatatttggttcttttcttatccaacactcttctaactcccgaactagtcactcacgcaagtcataattaagctaaggaaggtacaggaagtctcatttaagggaatcgggtcccaaacagtaaaatgaccagtcaggtcgttacaatctccccctcttaaacaaacgttcgtcctcgaatggacatagaaaagtacctgaactactgaataagtgaggatatctgctccgcatgccctcctcggactcccatgtcgcctcctcaaccggttggcccctccactggacctttatcgtcgaaatcctcttggatctcaactggcgatcctgcctgtctacaatagcaactggctcctcctcgtagcccaaattctcatctagctgaatggtgccgaaatccaatacatgtgataagtcggcatgatacttctggagcatcgacacatggaaaaccgggtgaactcctgataaactgggaggtagagcaagctcatatgcaacctctccaactctactcaacacctcaaaaagaccaataaaccttgggctcaacttgcctttcttcccgaatatcatgacaccctttattagcgagactttcaatagaaccttctcgccaatcatgaatgatacatcactcgccctctgatccgcgtaactcttttgtcttgactgagctgcgtgaagtctctcctggatcaatttcaccttctccaccgcatcctgcaccggatctataccaagcaacttagccttaccaggctcgaaccacccaataggagaacgacaacgtcgaccatataaagcctcatagggagccatctcaatgctggcctgataactgttgttgtatgcaaactccgctaagggcaagaactggtcccaatgatctccaaaattgataacacacgctctaagcatgtcctccagaatctaaactgtccgctccgactgcccgtcggtctgaggatgaaatgcggtgctgaagtgaacactggtgcctaacccactctgaacggccctccaaaactgggaagtgaactgagggccccagtctgatataatagaaaccggtaccccatgcaaccggactacctcccggatataaatctaagcatacctctccgctgtataggtagtcgccactggaatgaaatgagcagacttggtcaacctgtctactataacccaaactgaatcgaccttccgcaaagtctgcggtaacccaaccacgaagtccatagtgatgtgctcccacttccactccggaatacgcatctgctggagtaggccacctggcctctggtgctcatacttgacttgctggaaattcagacatctagctacatactctacgatgtccttcttcatcctccgccaccagtaatgctgcctcaagtcacgatacatcttcgtggcacccggatgaatggagtacctcgaactgtgggcctcctctagaatcctcctcctcaagccatccatgtcaggaacacatacacggccctgaagccgtaacacaccatcctcgccaatagtgacctctttggcccctccctgaagtattgtctccttgagggctgccagatgcggatcatcgaactgccgggccttaatctccccaataacaaagactgagccaccacacatgctagaactctgctgggctccgaaatatccaatatcacaagtctgttagccaaggactgatgtccaaggccaatggtctcttctcagcaggaatgaatgccaagctacccatgctttccgccttcctgctcaaggcatccgcgactacattcgccttgcctggatgataaagaatggtaatgtcatagtcctttagtaactcgagccacctgcactgcctcaaattaaggtccctctgcttgaacaggtgctgcaaactgcgatgatcggtgtaaacctcacatgacaccccatacagataatgcctccatatcataagagcatgaacgatcgctgccaactctagatcgtgcactgggtagttcttctcatgaatcttcaactgacgtgaagcatatgcaataactcgcccctcctgcatcaacacacatcccaagccaatgcgagaagcgtcgcaatatacagtatatgtccctgatccggaaggcaatacaagaaccggtacggtggtcaaagccgtcttgagcttctggaagctttcctcgcactcatcggaccaatggaatgggacacccttctgagtcaatctagtcaagggtgaagcaatagatgaaaagccctgcacaaatcgccggtagtaacctgctaaccccaggaaactcctgatctcggtcactgaagtaggacgaggccaactctaaactgcctcgatcttctgaggatccaccttaataccctctcctgacacaatatgccccaagaaagccaccgactcaagccagaactcgcacttggagaacttggcatatagtctctgctcccgcaaggtctgaagcaccactctcaaatgctgcttgtgctctcccaggctacgcgagtatatcaatatgtcatcaatgaagacaatgacaaaagaatcaataaaaggcctgaataccctgttcatcaagtccataaacgccgctggagcattcgtcaacccaaaggacatcaccaaaaactcatagtggccatatctagtcctgaatgcagtcttcgggacatctgaatcccgaatcctcagctgatgataccctgatctcaagtcaatcttagagaacaccctagcaccctgcagctagtcaaacaaatcatcaatgcgcggcaacgggtacttgttcttgatggtgactcagttcaactggcggtaatcaatgcacatccgcatagtcccatctttcttcttcacaaatagcactggtgcaccctaaggcgatacactaggcctgacaaaccccttggccaataactcctctaactgcgccttcaactccttcagctccttaggagccatacggtacgggggatggatataggatgggtgcccggagccaaatcaatgcagaaataaatatcacgatccggaggcatgcctggaagatcagaaggaaaaacatcggcaaactctcgaactactggcactgaatcgatcgtcgaggactctgctgtggtgtctcgaacatagactaaataagccaaacagcccttcccaaccatgcgctgagcctttagaaaagaaataaatctgcaagacgtatcaactgtggagcccttccactccaacctaggcaatcctggcattgccagagaaatagtcttggcatgacaatcaaggacggtgtgatagggagataaccagtccatacctaagataacctcaaaatcgatcatattgagcaacagaagatctgctctagtatcgcgaccacaaaaggtaaccacacaagaccgatatattcggtccacaactacgcaatcaccgacaggagtggatacataaataggaacaccaaaaggctcaggagaagcaaccagaaaacgagcaaatagagaggacacatatgaataagtagatcctgggtcaaacaataccaaagcactcctacagttgactgaaatagtacctgtgatgacggcatctgaggccaaggcatctggcttggcctggagagcatagaatctggctggagtaccggctgactggcctccacctgtctgagaagtagctggctgacctctccctgcctggcccccacctctgggatggcctctacctgcttgtcctccccctctaggtgcctgggctgctgaaaccatggactgctgcccctgctgaatagccttgccccgaagcctggggcaagccctcttgatgtggcctggatccccacactcaaaacatcccctcggcaccatagcctgatgtccggacgtctgctgacctgaatacccactggaagacccctgaatagctggtgggcgatatgaactctctggcgtggtgttgaactgagcactagagctcccctgataaccagaatacccaccgggagggccctgaatagcaggtgggcgataagaactctccggcatcgcactgaaataagacctcacgggagcacctcggggaggaggtggtgctggagctgaaactgggggcctgctgggatgacccctccctgggtgacctctacccctagctggggcatctctaaactcaccagagaatctggccctcttctcctgctgcatcttctcaaaacccctctgacaaaaaccctcgatcctacgagcaatctccagggtcatctgataacctatacccatctccacctctcgagccatagtgttcctgatagtaggatgcaaccctgccacaaaccgtcgtaccctatctgcctcagtggggagtatcataagtgcatggcgagataactcagagaatctcgcctcatagtcggtcactaacatctgaccctgctccaaatgctcgaactggtgacgcagcccctccctctcagaggatggaatatatctatccaagaacaactgcgtgaactgtccccaagtgaggggaggagaacctgctggtctgctgagaacataagacttccaccacctgcaggccctgccctctagctggaaagtggtgaagtcaaccctttgcgactccaatatatccatgttgtgcagcctgtccctgcacctctcaataaagtcctgggcatcctcctgaggctcagaagaccggggggcggagtctagtccatctatctaataacttttgcgggtctccgcccacagctggcatgacctgaggtactgccgcagcaactggttgaaccccacctgctggtggtgcatctggagtctgatagacggcggctgtgccacctggatcctgagcagtaggggtctgtgctccccctcctgcctgagaagtggccggatccgctagaaataaatcaacctgagtcatagagtccatgaaccggagcatacgtcacataactacctggaagcccggtgctgtcataaagtccactggggcaggctcagctgcaggtacctcgtcctgctcctctatagtaggatctgctagaggaatgaccggaataactctggggcaccctcgtaccctacctctggcaggtgccctcccccggcctctaccacagtctctagcaacggggggagcagtgcctccagggtcaggaacgtcagcggcacgcgtcctcaccatctgtgagagaatagaatggaagtttagtaccatgactactgcacgataggaagtaaacaaagagtagtctttcctaacaccatatagccccctgaagataaatacagacgtctccgtaccgatctgcaagactctattaggtctgcctgtaacactgtgagacctacgtgaacctagtgctctgataccatgttatcacgaccccaaatccataacgggtcatgagggcgcccaacaaccttgccggacaagccaaatgcggaaaactcaatcaagaatttaatgacactcacatctagaaaggggaataacatcccaaagggatttccaaaacccaatagagcaataatgcaaacataacgttattacaacccaaaataaaacgtctgctaaatgcacgtgccaagacccggtgtcacaatatacaggcatctaaataagaatatacaacacaccctgactgtccggaaataaggacaaagacagaaaggaatacaagagagactccatctggctgctggacgatgaagagatgggaagtagctcactgtggaagtctaaccgctgctcactatcgcacaccctgatgatatccagatgaatcagcctcagaccctgtacatttaagtacagaagcgtagcatgagtacataaacaacatgtatccagtgagtatcccacctaatctcggagaagtagagacgagaggtcgactcgatactcactaaggtcaaaatatataatgaaagtgacttaccataagcagttatatcacagagtataaagcactaaacatggatagtaatacttcctctttttacccttttataggcagaactcagttacattaatataagggtcaatgataataaaaccaggaatataacgcgcaagtagatgaaaataaacatacgcaattaaccaccaacgaacgtacggcccgatcgaacagaaatgtaaattatgcactgccgagggtcgaacgacccgaaccaataaatgcatctattaccccgcttgcaaatcctgtgcgatgcggtgaacagaaagtaaacacataacctcgctcgcaaatcctgtgcgacgcggtgaacagaaagtaaacacatattcaaatcgtcaggtaatgatgaccaaagaggcataccctttccttttaacagtaggcaagtatagctaccaaggttacagtttattcacaccaggccaacagtggcaccaacaacataattatcacttgaagcatgctcatggtcctaatctacccggactttggcatacaagtcactacgcacggactctcgtcaccttggtacgtacgtagtccccggatacaagcaaattcttatttagtcattaagtcctatgaggaaaattccctctcacaagattagaaaggagactcacctcgctcaaattgcacttccgaatagcaaacacaagctcggaacctcaaatgaagccgaaagcgcacaaactagccaaacaatatatgaactagtcaataaagatttacaacgttgatttctagccatttaagtgatttcccaacctttcccgcaagttttctatattccgaccccgtacccgaattccgatatttttcgtaggaaaatattctctatagcctaagggttactaatatgtagattttagttcattacatagctaattaggtgattagatcgtagtttttaccaaaaccctaggtctagctctaacccttgatttttatttgattattggtattaaatctaagttataatcatctagttaagctaggagggagtggggattacttaccttgtgaagaagtgaagaaaccctctctttggaatctctaaaatcgccccaagtgaagtgtataaatgaaatgaaggctaaaatcccgcttttaaagaccctacccaggccccgggtgtcgcatttgcgacaaaaatctcgcaaatgcgaacacccataatttttcccccacttcacaattgcgaaccaggacctcgcatttgcgagtcctggcttgacctgcatcagttcacaaaagcgaacaccatgtcgcaattgcgaccccctacccatgcctgccttgttcgcaaaagcgaaccaaatctcgcaaatacgagtctcgcccagccagggccaagttcgcaaatgcaaaatcaacctcgcaaatgcgaggtcagacccagccatgccaagttcgcaattgcgaaccagacctcggaaatgcgaacattgcagcagcagcaaaaacaccagcagctgctgctgtgtttttgcacaacacacatcgatccgaacctcacccgagccctcggggctctactccgaacacccatgcaagtcctataacctcatgcaaacctacccaagcaataaaatccttaattaacacccaagaacacggaactgacacccaaaatgcatgaattccttcaaaaacacttagaattctatatttccaaccgggtgtccgaatcacgtcatatcagtcccgtttcacgccaaatttcacagacaggacccaaataccaactcgaacttgtaccgggctccgggaccaatatacgggcccaataccaatatggtcgagttttggcgaccttccaagttattaacttccaccaacgggtccaagcgaccctaaactatccggattgacaccaaaccttacgggtaaatcatatatattattttggacctgtaccaagtttcggaactggaatccgaacctgatacctaggtttttaacaattaaatagattaattaattctccgaaactgaaaattaataattttacacaaaaattcattactcgggctagggctatcggaattcgattccgggcatacgcccacgtcccatattttcccacggacctctcgggatagtcaaattacgaatccgggtccgtttcctaagaaagttgaccgaagtcaattctaaccttttaaagaaaaccttaaggaatatttggtttttatcttatccaacactcttctaactcccgaactagtcactcccgcaagtcataattaagctgaggaaggtacgggaagtctcatttaagggaatggggtcccaaacagtaaaacgaccagtcaggtcgttacatgggcgtatgcccggaatcgaattccgaggtcccaggcccaagatatgaatttttccgtgaaattgttttatgaaaatatttgaagaaaatgaaaatgaattttgatcaaaaagctatggtatcgggctcgtattttggttccgacgccctgtacaggtcttatatatattgtttaagcgctatttttgatgtttggtcgaaatcgaacgtcgtttgacgtgtttcggaccttggaagctaagtttgaagttttgaagttcaaattggaaaataaggattttatggtttaattcatagattttgatgttattttggcgatttgatcgctcgacttagttcgtaggatgtttatgagttagtgtatgtgtttgattgggagccccgagggctcgggagtgtttccgggggtagttcggggtgtttttggttttgaaacttggcaaattttctgcaatttttgctcaggtgcttccttctgcgatcgcatctcttcatctgcgatcgcatagggcagcttcaggtggctaaagatttcctctatgcgatcgcataaactggcctgcgatcgcatagcttggtcgtctatctcagtgcggtcgcattcccttggtcgcgatcgcgtagggttacccaggccagacccagctttcttctatgcgatcgcgtttcctctcctgcgatcgcataagcctgaacccttcatctctatgcgatcgcgtcccttttcctgcgatcgcataggctaatttcgcctagtgaattataaattctagaacactgttcataacgaaaatctcacattttctctcacgaactccctccctaaaaccctccattgaagagattcaagctctcatttctccataactctttaggtaagtatcctccacttcattcctccattatttcttccattaatcttcaacttcctaaccctaaaacatgaaatcaaactagaatttaggggcttttgggtttagctagggtttatgggatttttggacatttcaacctcaatttgaggtagaatttaaaatctaattatatatttgaactcgtggggttatgggggattgggttttggtccgatcctcgagtttggaccacgtgggcccggtgtcggattttgatatttttgaaagaaagctaggaaatacatttctaggctatgggattgtatttttgtattattattgataatattgaacctaattatgcttagatatcgttgtttgggaatcagattctagaggaaaggcggtgttagaggcttgattgctagtttcggcatcgaggtaagtgtttgatctaactttggcttgagggattaggattaggatattatttgctatgtgctatgtggtgtcggtgtataggtatggtgacggttacctatgcgcccgagtcaagcatgaccgtgggtcttaattgccttagtttaatgttgtgatatagattcttgttgttgaattgactcctatgatatgaattgttgaagttaaatgaataatatgacttaaagaagaacttagtgtgtatttccttgccgcaatgtgtagaattcggttgtagactctcccttgtcaggattttttggtttagctgtacccttgccgggtttgagatatttattgttgtttccctaaaaggggcctatttgtgattgaacggagttggtactccatgttgctgggatcgtgtggcgcgccgtccacctgtataacatattctgggatcgtgtggcacgtcgtccacatgtgtattatgaacttgggatcgtgtggcacgccgtccactgttgtacactgaacttgggatcgtgtggcgcgccgtccactatgtgttttgacttaactgggaatctgtagctttattattgtgttagacttgttccttctgtctttactgtttccccgatagcatgttcccttcccgttttgcttatgtattttgttattattcgtgcaattgtatagatacatcttgtacaggttatttgcggtaggtcctgtctagcctcgtcactaccttgccggggttaggctaggcacttaccagcacatggggtcggttgtgctgatactacacttctgtgcccttttgtgcacagatccgggagcagcttacggacagcagcagccgcaacagtagatagggagcacgccttcagtccacaaactgctaggtagcttattggcgttcgtgggcccctcagtctcttctcacttatgtagtttgtttcttgtttcgaacaaacagtctatgtatctctttctttcaggccattatatgtagtaaaattgtagaagtccgtgagtgctgtgacactgtttctgggtagaggattctagttgtttctattcccgcactatatttctattattaagttaaatcttagacttccgcaatattattactgttttcgcttatcattctgttaaattttataattgtttaattcttgctaagaggcttgcctagctccgacagtaggcgccatcacgaccccgatggttggaaattcgggtcgtgacaagttggtatcagagcactaggttacttgagtctcacagctcacggacaaactcggtagagtctgagggttcggtgcggagacgtctgtatttatccccagaggctacagagttaaggaaaaaaaatctcactttgttcattcttgtcgtgcgattctgtttctcaaatactaattgtctttctactctgttctttcgcagatggcgagaacacgcgcttcctcatcttctgcgagtcagcctgagcccccagcagtagcatctggcaggggccgaggccgtgctagaggccgaggccggggcagagctcagccccgagcggcagttccagaggtggagcctcatgtcgattatgctgaggaggttccagctccagcagctccagtggccccaggtcaggtcccagagggctttattgctacgctagtgcttcaggacgccttggtccgactggtaggttttatggagggtatttctagagcgggcttgcttccggtagctccagccgcatctccagctgggggaggagtccagacccccgttactcctactccaaagccggtagttcctcaggctccggtccagattccaacagtgcagccagctgtgccagtacgaccggcggtgccagttcagccagttcagccagttgtggccacccagccagtggttgcgggccagtctagtgatggtgcggctatgtccgcggatgctttgtggagacttgacctctttaccaggctctttactcttactttcagtggtacgccttcagaggatgctcagaacttcttgttcagttgtcatgaggttctacggaccatgggtatattggagaccaatggggtcgattttgctacttttcgcctggccggatccgccaagacttggtggagagatttctatctatctagaccagcagggtcgccagctttgacttgggatcagttttcggagttatttctggggaagtttctcccagttactcagagggatgccctccgtaggcagtttgagcgccttctgcagggatctatgactgttactcagtatgagacgcgatttgtggatcttgcccatcatgctattttaatactccccactaagggcgagagagttaggagattcgttgatgggttgactccgtcgatccgggttcagatggctatgagtgccagtagtgatctctcatttcaggaggcggcagatggtgctcgccggattgagatggcactttctctgggaagtggtttcgggtctgataagaggccctatcattctggtcgattcagtggtacctcgtctggaggtagggattcatatggtaggggccaacctccgaggccttatcagtcggctctccaggcttctcatggttcccccggtggtcgtggttctcagtcacagtatttcgatcagcagctctttagttctccatcagcacctatcagtgcagcaccacttcggtatgctcagcagccgagagcttgtttcacctgtggcgatacgaggcacatcgctaagtattgcccccgagcttccagcaactcccagcagcagggaccccgtcccatgattcaggcaccacctgccccacagcctgcccagccagctagaggcgggggtagatgtcatagaggtggaggcagaggtcatagaggtggagctcagccagctagaggtaggggtcagacaatagcagatcattctagagatgctatttagggaggtggaccccagcccctttgttatgctttgccagccaggccagaggttgaggcgtcagatgcagtgatcataggtactattctggtttgtgatagagatgcttcagtattatttgatcctggatccacgtattcatatgtgtcattatattttgcaccttatttggttatgcctagtgaggctttgggtattcctgttcatgtatctactccagtgggggattctatagtagtggatgaggttcatcgctcttgtgttgtggtgttcaggggtcttgagacccgtgtcgacttgttattgttggatatggtggatttcgatatcattctagggatggattggttgtctccttaccatgcgatcttggattgtcatgccaagaccgtgaccttggcattgccggatatgccccgattagagtggagagggaccccaggtcataccactcacatcggtatttcttatgtgaaggctcgatgcatggtcgagaaggggtgtctagcttatctggcttatgttcacgactccagcgctgaggtcccatctattgattctgttcctattgttcgggagttccctgaggttttcccttctgatttgccgggcatgccgcccgacagggacatcgatttctgtattgatttggtgccgggcactcagcccatttctattccgccgtagcgcatggcgccgccagagttgaaagaattaaaagaccagcttcaggacttgcttgagaagggtttcattagacctagtgtttcgccttggggcgcaccagtattatttattaagaagaaggatggttctatgagaatgtgcattgattaccggtagttgaacaaggtaaagattaagaacaagtatccactgccgaggatcgacgatttgtttgatcagcttcatagttcgaaggtattttctaagatagatttgagatctggttatcatcagctgaggattaggacgtctgatgtccctaagactgcttttcgtactcggtatgggcactacgagtttttggtcatgtcgttttgattgactaatgccctagcagcatttatggagttgatgaatagagtattcaggccgtatctggatttgtttgtgattgtctttattgacgacattcttatatactcccccagtcaggaggagcatgagcagcacctcagagtggttcttcagactctgaaggatagtcagttgtatgctaagttctcaaagtgcgagttttggttgagttcggtcgcattcttgggtcatgtcgtgtcagcagcaggtattcaggtggacccgaagaagatagaggcagtcaagaactggcctcgaccagcttcagctacagagattcggagcttcttggggttagctggttattacagacggttcatggaggggttttcatccatagcatcccctatgaccagattgacccagaagggtgccctattcaggtggtcggacgagtgtgaggcgagctttcagaagctcaagaaagcattgaccacgacaccggtattagtgttgcctacaggttcaggaccgtacacggtctattgtgatgcttcccgtatcgggcttggtgcagtattgatgcaggatggcaaagttattgcctatgcttcgaggcagttgaagatccacgagaagaattatccagttcatgaccttgagttggcagctattgttcatgccttaaagatttggaggcattacttatatggtgtgacgtgtgagatttacagcgatcacaagagtcttcagtatctgttcaagcaaaaagagttaaatatgaggcagagaagatggttagagttgctgaaggattatgatgtcactattctatatcacccggggaaggccaatgcggtggccgatgcattgagtagaaagtctgccagcatgggtagtcttgcttacattccagtcagtcagagatcgcttgccttggatgttcaggccttggccaatcgtcttattaggttggatatttctgagcccagcagagttttggcttgcacagttgctcgatcttctctatttgagcgtattcgtgagcggcagtttgaggatccccatttgtgtgtcctgagagacacggtccagcgaggaggtgccaagaaaatgactttggggagtgatggtgtgttgagattgcaggggcgagtttgtgtgcccgatgtcgatggtattcgagagttgatcttagcggaggcccatagttctcggtattctattcacccgggcgccgcgaagatgtatcaggatttgaagcagcactattggtggcgtaggatgaagaaggatatagtagtatatgtttctcggtgtttgaattgtcagcaggttaagtatgagcatcagagacccggtggtctatttcagaggattgagctccccaagtggaagtgggggaggattaccatggactttgttactggtcttccgttgactcgaaagaggtttgatgcagtttgggtcattgttgataggctgaccaagtcagcgcattttattcctgtggccgtgacttattcatcccagagattagctgagatttatatcggggagattgttcgtcttcatggggtgaccgtatctatcacttcggatcgaggtccacagtttacttcgcatttctggagagctttgcagggagagttgggcacccaggttcagatgagcacaacattttatccccagacggacggtcagtccaagaggacggttcagattcttgaggatatgcttcgagcctgcgtcattgattttggaggctcgtgggaccagtttttgccattagtagagtttgcctacaacaacaactaccagtccagcattcaaatggctccgtatgaggtgttgtatggtaggcggtgtcggtccccagtcggatggtttgagccgggagaggctcggttattgggtaaggatatggttcaggaggccttggataaggtccggattattcaggatagactccgtacagctcagtctaggcagaagagttatgcagaccgcaaggtcagagatgtggttttcatggttggtgagcgggtattgctccgtgtgtcgccaatgaagggcgtgatgagatttggggagaagggcaagcttagccctaggttcatcggtccatttgatattcttgatcgtgtgggagaggtggcctatagacttgctttgccacctagcttatcagctgtgcatccagtatttcatgtgtctatgctccggaagtatcacgacgatccatcgtacgtgttagatttcagcactgtccaattggacaaggatctgtcatacgaggaggaaccggtggctattttagaccggcaggttcgacagttgaggtcgaagagtttcccttcagtgcgtgttcagtggagaggtcagcctcctgaggcttcgacctgggagtctgagtccgatatgcggagccgttatccccatctatttcccgactcaggtacttctttattttgtccgttcgaggacgaacggttgttttagaggtggatattgtgacgacccaaaggggtcatcaccgtaaatccttttttgtgcttcagaggtctcaaaaacctctcgtagggttgcctcgatttgcgtgtgcagtccgggcgcgaagccggaaagtttttatattgtgaaacttgagttatatgtttaaaatgataaattttaagtataataatgatatggttgacttcggtcaatattttgggtaaacggacccggacccatgatttgacggtctcggaaagtccgtaggaaaatatgggacttgggcgtatgcccggaatcgaattccgaggtcccaggcccaagatatgaattttttcgtgaaattgttttatgaaaatatttgaagaaaatgaaaatgaattttggtcaaaatgttatggtatcaggctcgtattttggttccgatgcccggtacatgtcttatatattgtttaagcgctatctctgaagtttggtcgaaatcggacgtcgtttgacgtgtttcggaccttagaagctaagtttgaagttttaaagttcaaattggaaaataaggatttgatggtttaattcatagattttgatgttattttggcgatttgatcgctcgacttagttcgtaggatgtttatgagttagtgtatgtgtttggttgggagcaccgagggctcgggagtgtttccgggggtagttcggggtgtttttggttttgaaacttggcaaattttctgcaatttttgctcaggtgcttccttctctgcgatcgcatctcttcatcagcgatcgcatagggcagcttcaggtggctagagatttcctctatgcgatcgcataaactggcctgcgatcgcatagcttggtcgtctatctcagtgcggtcgcattcccttggtcgcgatcgcgtagggttacccaggacagacccagctttcttctatgcgatcgcgtttcctctcctgcgatcgcataagcctgaacccttcatctctatgcgatcgcgtcccttttcctgcgatcgcataggctaatatcgcccagtgaattataaattctagaacactgtttataacgaaaatctcacattttctctcacgaactccctccctaaaaccctccattgaagagattcaagctctcatttctccataactctttaggtaagtatcctccacttcattcctccattatttcttccattaatcttcaacttcctaaccctaaaacatgaaatcaaactagaatttaggggtttttgggtttagctagggtttatgggatttttgggcatttcaacctcaatttgaggtcgaatttaaaatctaattatatatttgaactcgtggggttatgggggattgggttttggttcgagcctcgagtttggaccacgtgggcccggggtcggattttggtatttttgaaagaaagctaggaaatacatttctaggctatgggattgtgttttttgattattattgatattgaacctagttatgcttagatatcgttgtttgggaatcggattctagaggaaaggcgatgttagaggcttgattgctagtttcgacatcgaggtaagtgtttgatctaactttggcttgagggattaggattaggatattatttgctatgtgctatgtggtgtcggtgtataggtatggtgacagttacctatgcgcccgagtcaagcatgaccgtgggtcttaattgccttagtttaatgttgtgatatagattcttgttgttgaattgactcctatgatatgaattgttgaagttaaatgaataatatgacttaaagaagaacttagtgtgtatttccttgccgcaatgtgtagaattcggttgtagactctcccttgtcgggatattttggttgatagttgtacccttgccgggtttgagatgtttattgttgtttccccaaaaggggcctatttgtgattgaacggagttggtactccatgttgctgggatcgtgtggcgtgccgtccacctgtatatcatattctgggatcgtgtggcacgccgtccacctgtgtattatgaacttgggatcgtgtggcgcaccgtccactgttgtacactgaacttgggatcgtgtggcgcgccgtccactatgtgttttgacttaactgggaatctgtagctttattattgtgttagacttgttccttctatctttactgtttctccgatagcatgttccctccccgttttgcttaagtattttgttattattcctgcaattgtatagacacatcttgtacaggttatttgcggtacgtcctgtctagactcgtcactacctcgccggggttaggccaggcacttaccaacacatggggtcggttgtgctgatactacacttctgtgcccttttgtgcacagatccgggagcagcttacggacagcagcagccgcagcagtagatagggagcacgctttcagtccagagactgctaggtagcttactggcattcgtgggcccctcattctcctctcacttatgtagtttgtttcttgtttcgaacaaacagtctatgtatctctttctttcagaccattatatgtagtaaaattgtagaagcccgtgagtgctatgacactgtttctgggtagaggattctagttgtttctattcccgcactatatttctattattaagttaaatcttagacttccgcaatgttattactgttttcgcttatcattctgttaaattttataattgtttaattcttgctaagaggcttgcctagctccgacagtaggcgccatcacgaccccaatggtggaaattcgggtcgtgacaattttcaagttacttttcatggtgggtggctttataattcattttactgcgcactattctgttgtttattggcatcgcgacatgcctttccagctaattggtgccaaggcaaaatttatgatcgaggtcattcttgtgatgactgcagcagtcctgcatcaccttttggagttcaattatgggtatctcgctctattactaggttgcaccacatatttctatgtgtatgctcacttcatgcacgtatcatatgatatcgtggaaaaagacttattgctggaattagtaatgcaagttcttgtttacatggtggacggagaattgttagttagagctttgtctttgagcttctgcgttagtttatgcttctatagatacatgatatattgtgctcccgaagtacctgaacatcctaaaaaggagtcggagcggctgcctgtctgatttggaggtgtccgtggtgtaatggtaatattgttccgtgtgatctataggtcatgggttcgagccgtaaaatcagccactgatgcttgtattagggtagactatctacatcacatccccttagggtgtggcccttcccccgaccttgtatgaatatgggatactttgtgcaccgagctgtttttattttattttatagcttattttgtgcccttatcactgtgtaacccatatcaattgtacgtcagtggagaaaaggaagaacatttagacacagtttccatcaggattcggcacatttttattaaatattagactgaatgaatttgcctctatgaaaggtccccaaaaataggaagttttctctatctaagtgaaaaattggacaaaacctctagaaaaaacatctcttgtatatctaatattttttattgaataaagttcatttattgaaagcagtatagtggttcaacagccctatctccaggttgcggtttgaaatcttatatcaaggtaattgaatataggattatattccatttttgcaatttatgtttttattttccctataaattaaataaatcagagtttgcactttgcataaatcagatcattttcatgctttcaactttatgagttctaaattttaggataatgacatcgaaaaaacatatttaatgaattttttaatataaaatataacatccagacaaaatcaatcggatccgactgaacccgtatgttactttctagctttgccctgcctaaaggaacatttaaaagaaaagaaatccaaggttggtggctggattttaaatttttgtttctgtcgcttcaacattttttttttttcaattactacaaaaattgtagcctacagaagatagtggtatgaataatttgtttgtgttttttgatgaataaacttcatttttggacttagtggggctcattgtctctgccatccggccatatgtacctcgggagccctgcccattcaaatcaaaatagagcgagcacctacgacaatggggaatgtaatgtcgatcacagggtgagggaattttataatacgagggcgcgacagcaccaattatgagaaatccaccaatccacatgtaatgtgtgaacaataacagttgtgtacagtagctagatacggataaggggacatggaatacatatggtgagctacattttatttatgcatgcgaattgactttacaagtaatggcttcaagttgtttggtgactttttcccctgtggatatttcaatatctaatatgagttatattagcgtaggttatctatatcatacagctggagatatgatcctttccgaattctacgtgaatgcggagatattgcccttgtatattatatatatatatatatatatatatatatatatatatatatatatatatatatatatttacacacactattagcgaaagatagagttcataattattttttcacccaaaaaaaaagtaagtactacatgggtttgagattcatatctcaaaagttgtcattgtgattccttttgtaatagatatttcagtaggagaacaactactaaactaaagtggtatgaaaatgcaaaaattcatttattaatttgacgggatagagttctatacataaaattgagattatataaaatataatacaactagccaaacacactctcataatcagctgaagtttttgctcttgcaaatttaaatgctatgcaagcttgatgtacactgtatgtatataagaatctttgattaagcaatgatacttctagacacgtgtgtttggtaagaaagaacatatttttttttttaaaaaaataaaccattttttgctgtttgacgataatatttccaagtaaatatttttttaccgaaacggaagatataacttcctttacaaatcataaaatcatcaataaatgatcacggaatggataatatatatatatatatatatatatatatatatatatatatatatatatatatatatatatatatatatatatatatatatatatatatatatatatatacacgatagataaataatactgtatatatatcaatatactgataatagtaggactgtattaggcctaagaagttaaatattaactgtttaaccaaaaatctgaggctttggtcaaagctagaaataaagaaaaattcgagttactgataatcaggagacgaaaataatcgaagacttttgagaataataataaagcaataaatagttttgtatttcagtgtaatctcgatagtttttcgtgtccttacagatgttgagacattctccttttatagttgaatctaggagaatgtgtaatgccttattcttaatgaggcaattatgagcaataaatgacattaaaagaaacgttacacaatcattcctattaaatatagattctccaacacatttgatatttaatattgaatttgtactcttttacgtcatcagattcatatcttcaatcccttccgatctccgggctttaaatgactcgaataggtacgagattcgtgccttttgagtagcgactcgtgcctatttaactttcttcttcccgtatctgttgtcgcctgtgcctcttggctgattatcgtgttttaaccacttgaccagtacacgtgtcatgacacgtcatcttctatatatagactcagtgtttttccaatacagatagtcccccactttttatttattaatcgattaaatatttgggaagtagatcttcataaaaagggaatttttgccataatcaatgctatgacagtactgacgcttcagttgtcttttttatttaatgctctgcacacgtgttaccttttgattggctctgtaattctgcagccttttttcaaggcttcttcatcccctctattcacgaagcgatagttgcctttattataggctttccatcattacacttctttgtttgacagttgctattatatacacatttaaccctttttactttctcttcttcttcataaacccttaacagatactttactctttacttttattctcttctcctttagttcatcctttctctgcaatgtcgtcttcgaaccctaaccctaagagagtcccaattcttgacagcttccccaatgcccctgtaagacatagaaggggtagaggaggcatgcttcgtagcctaggatccgttggtggtggttcttctggttccatcactcattcttctagctctggcactgtttctagaggttctatcaccaagaaatcctcctctaaaggtaaagaaccttctgagcctcttcaagaacctttagttgaggaaatagtaccaaatgacttatcttttgagaatgatagaaaatcccttcatgaacaggttgttaatttagagaaagctgacactttttgttctttaattactgaacctttgattcttattgttcgaaaagattgcccctggagaaatgatcttcgtatgatgatccctgatccaaaccagagaattttttcttttaggattgaattttcttttgtttatacttatcccttcacgttgggatttactcctgctatcgacccagttatatttgagttttgtcgtttttttcaaaatttatttagcacaagtcgaccctcttgtatggagaacagtggcttgtttaaggtatttatccgtcaaagccaatgttaactttacctttccccatcttattcatctttaccaccccaagctattccgccatggggtttttactttaactgcaagaagtaaaagagtcttggtaagccctgaagatgataaggatcatgggtggtacactcgttatgttgctataagcacagttgatttggtggatgaaacaaatatccccttccctgagaagtggaactttgcacgtaagttttttttttaccttaccgtacctatctttaagaatttcaatttcttttctaatttcgtctctttttgattttttgtagcaaccatgagagatgtggaacccgttcctaatttctgtggttgggtgtattcaatcttgaaagccgtgcttatggaggcgagaacttggaaatccatttcccatttacatggttggaaagtgaaaactcacggcatgcatctctttatgctttttcgtatgttaagtcctttcttgtttctaactttttattcttctttttgttaggatttgctattcgaggaatgaaagccgaagtagctattgcccttcgagcctcttctggaactccactctctttggaaagaactcaagctatgctgtcaaaaagaaaaattatggaagaagattctgaagatgatgaagatgaagatacctctttaatagctaggccaagagccaggagacacatcgtttctgaggatgaaactgaagttcctcctgcccgtgcctctctttccgaacctattcacattccttctgatgatgaaaccactccaagggacaccaatgaggctattcaacgtctctttgttggtggttttgaaagttgagaacttggtccggttctaaatgaagttcctctttcctcctctgttcccatttcttctattcctcccttagttacaagcgtttctttgcccattttatctgttcctgcttccttacctgtttcggctcccttatctgaatctgtttctaacgtcctagctccgactccttcgactcctgttatttttacttattctaccgctcctccttctatagctccctcttcctcagttcaacgtacataggagggttccagtagtagaagtttgacttagaggagcatgacacttgaagttcctgctaataacagtctcttaaggaagtctggtggagctgatgtctggcttgggcctctaattggagatattgaaaagaataagatgaaaagccacagctgcttaactttgatgaatgacatagttcattctactttgaaggtatttttccttaacttacaagtttctttttatctctagattcttactttcatgctttaccattgtaggctaatcttattggcactgaattgatgggaagaatctccactttagagaagaaggctcgtgaatctgaaaagtctatttctgaggctgagagaatagccaaggaagcccaactagaagcagctaattggaaggagcagtttgaaaatgctcagggaaccataaaagaattgcaagagagtagaaatcacctggagcagcagaagcgagtactgacctctgaattagcagttgccaaagcttcttcaagtcaatttgagaaagacaagaagcgccttgaatgttgcttttcagaacagttatcaaaatccagtgaagaaatcagagaacttaagacactcttggacaagaaagaagaatatgcaggagaattagtgcaaaacttgactcaagctcaagctgatttaaggatctcctctgataagatacgtgccttaggaagttctcatgcctcccttgattcccatttagctgaacatcaagtgttaaagaatgaccttgctatgtgggaaagggagtatgaacttcttgaggagaagtttgatttagaagtgagttgggctttcttaaattctcgtcgtgatgctttaatggaggccagtcaagaaaactttgacttaaactcagagttggccaaggttttagaagccattgaaaaaacccaacaaccacttaactttccttctccggcaatggaagctcccgtggctgaagaacctttaaatgatgaagtcgttgctgtggcagttgaagttgaaaatgttgcaattccagctcccgagggtaaaacttctatgactagtctgtggaagcagagacttccgtgactcttgctcccctcgttgaacctaacacttcaagcccagctgaaaccgctcctgttgctgcttcttcagaggttaccgccgtacctatggctgttcctgaaaatgaagctaatatagcaacttctgatattccagcctctcagtgaccagtttatgtttccagactttgtttttgattgtttttgttgattggtggtttatcccttggcagttttaagggatttcttggaaaagtccccagttatcataatggggcacttgtaaaaatattttgctgactaagtttttacttagtctttttaattatattgaaaagttttcttagtacttctatacgttctattcttgctttttttatttatttaggacttatagaatagcttagcatttttatcttttgaaaatgctttattattcttctcatgaattattaacatgaggtttataaaagaggacccttttatatatatatcgacacttaatgaagaagacgtctcaacttcataatggtgttacaatacgacgaaagaaataggaacatatatattttgtttgaaacaactttgacaagtttttattcatgaacttggacaagcttttgaatattacatgtattgaaatacatttataactttctcgtaactgtttttcttgtaacagatttttataaaataaataaaaaataaacaaggtttttccttataacccatttcagtacatagttatgaccctatcttcatgtattaggaagggtttgagaggtgactccgttgttatcatgagtttgagaggtgactctgtttttctcatggaaaaaatactatgatgaatgctgaaaactccgtaacttttactcaacacttgtctctttgtagcttgatttttctcttaaatcttgctcaatcttgtccgattttcgtatctatgtttctgcacgtatccgtgcataatatgtagtcccccaagtgtttgagcggtgaagtatgaagcctcgagcacttgtttatttctctcaatttggttcttttcctgaaacagaaaaacatacgggactcggaggtgcgattagagatgaagactgcctaacccgtgtgtatttttatcagattaattgtaaccatgggctgggaattttagaatattccattttgctgtgcaggccgtgactcatcatttggcacgagttagggttttttcctagcatctaaaatcattagtaaaactttaacaattcaaagaaaaattctaacatagcgatacctgaccgtgggtattttttcagaagtaatatctctttaggtggacagcattccaatgtgagggtagaaccttgccatccattgtcttcaactcgtatgctccttttcccgtaatgtcatgaactctgtagggtccttcccatgttggacttagctttcctaaattaaccgcctttgtagattggaacacctttttaagcacgaagtcgatccccaattttaaagaatctgaggcgtgctctcctgttgtaatatcattcaattacttgcttttgtgctgccatccttattaatgccgcttctcttcttccttcgagaaaatcaaggttcactcgcatctcttcatcatttgattcctccgttgcttgaacgtaccgtgtgcttggttctcctatttcaactggtattaaggcctccgctccataaaccattgaaaatggtgtttctcccgtgcttgtttttgtcgttgtacgataagcccataataccccaggtaatacctcaggccagttaccttttgaatcctgtaaccttttcttcaaattattgataatgaatttatttgtggattccgcttgtccattacttactggatgatatggcgtagatgttattcttttaatttgccaactttgaaaaaattctgtgatttgacttcctatgaattgcggaccattatcacacacaatttcctttggtactccaaagcggcatattattttcctccaaatgaagtccttaacttctttctctcgtacgtgtttaaatgctcctgcttctacccatttagtgaaataatctgttagtacaagtagaaacttcacctgaccttttgcttgcaatggacttacgatatccattccccatttcataaagggccacagagctatgacagggtgcaatagctcagctggtctatgcatattattgccgtatctttgacatttatcacatttagacacgaaaccatctgcttcctcctccatcttaggccaataataccctgctcgaatcaatgtttttatcaacgaccttcctcatgtgtggttttcgcaatgtccttaatgtatttccctcatcacatattctgtttgggaaggtccgagacgccttgctaatggtccaccaaacatctttcgataaagattttcttgatataaacaataacgagcaaattttttacggagtgcatgagcctttcttttatcatcaggtacggtttcgtgctgtaaaaaatcaacaatttcgtttctccaatcccatgttatatgattaaaatttacctcgttcttttcagattcgagaagggaatgaaataaatgcacgactgaagcaattgcgttgtttgctacgtctgctgcagatgcgagattagctaaagcatctgcctccacattctcatctcttgggatatgcattaccttccaagtttgaaattgctttattagttcccgtaccttttctagatattcttgcattcgtgtttccctggctgtataagtccccagcatttgattgaccatgagttgagaatcactcttgattataatttgtgttatgccgagttctcgtgccaattccaaacctgcaattacagcttcatactctacttcattgttagttatggaatgacattttattgtttgtctaatggtttcacccgtgggtggtatgagaactatccctaggcccgctccttttacattagatgaaccatcagtgaataaaatccaagtccctgggtttgcaccattaaaaacttgtaattctttttctgcttctagttgtatccccaaactaaaatcagctatgaaattagctaatacttgagattttataacagtcctaggttgataagtgatttcgtattcaattaattctatagcccattttgctaaccttcctgacaattcatgtttatgcagaatgtttcgtaacggaaaagcagtaactacagcaatgggatgacattgaaaataaagtctcaattttatagattccatgatcaaagctaatgctaatttttctagttatggatatcgtgtttcagcatctagtaaaaacttgcttacataatagataggagattgtttaccttggtcctcacggactaaaacagcacttaccgcaacttctgacatggccaaatagatgagtagcttttctccttcctttggttttgccaataacggtggatttgacaaataagctttcaaattcctaagggcttgttgacaatcttcgttccattcaaaatgatcttgctttttgagtgcggagaaaaatttaaaacattttctgaagatttggaaataaatctccccaaagctgcaattcttcctgttagcctttgtacttcttttttatttgtaagaatatcatggatttcctctattgctttgatctgtgaaggatttaccttaatgccacggttagaaaaagaaagcccaaaaacttacctgaggcaaccccaaatgcgcatttctctggattgagtttcatattaaactttcgtaagatttgaaatgtaacagataaatgagaaatatgatcatgagaatgctgggttttgactagcatatcgtctatatatacctccatggttttttctaaatgttcttggaacattttggtgaccaacctttgataggttgctccagcatttttgagaccaaagggcattactttataacagtaagtcccctgtctgtgatgaaagaagttttttcttcatcactgggatctattttaattaggttgtaccccgaatatgcatctaaaaaacttaaaagttcatgtcctgcagttgcatcaattaactgatctttatgaggtaaagggaaagaatcttttgggcaggctttgttaagatctgtataatccacgcaaacccaccacttaccatttttctttggtacaacaactgtattagctaaccaattaggatactttacctcgcggattgacccaatttttaatagcttttggacctcatcttgaatcacctggtttttgaaagccccttgctttcttttcttttgctttactgatatgaaggatgggtcttcatttagtttgtgagtcatcacatccggtggtatccctgttatatcagtatgggaccaagcaaaacagtccacgttagcttttaaaaattcaatcaacatacctcgcatgtctgagcttaaattggctccaacataaacctttcgttcaggccattgttcaaacaatatcacagcttccagctcttcaattgttgttttaatattttcattctcttcaggttcatgaattgtatcaggtctctagtctaaatctgtcttttcttgttcaattgaggtttgaacggtgattccctcaacttcattcacggtgctcgtatctgttacaacattaatactcctagttgtatgttgttctccacgaatttgacagatcccctatggtgatggaaattttatgacttgatgtagagttgatgggacaacatccatataatggatccacggcctcccatcattatattgtgaaccatctccatgtctactacctgaaatttagtttctttcacaacaccctctgcaaaagttgttagagttacctcacctttagttaccacactggaattatcgaacccggataaagtatacgcctttggaatcattttatcttcagcttgcatctcacgtaacacccttaataggatgatgtttacagaactccctgggtcaatcaaaactcattttacattagcatcatgtacaagtaaagatattaccggtgcatcgttgtggggagtgatcactccttctgtatctacatcatcaaaaatgatactttcatcctctaaaatctgccgcactcgctttccgtgtgtgattgttactttggaaacgttgtttgaagccgtatatgatactccataaatgtcctcacctccactgataacgttaacggttctcttggataatggcagttttggtggctcttacctatttttcatataggcttacttacctttctcactaaacaactcagtaagatacccttgctttaagagatggtccacttcgatttgtaagaatctacatttttatgcccatgatcattgtggaacttgcaccaatggtctggattacgcctgtttggatttgaccgcatctccttcggccaccgtaccttatctcccatactcctcaaaacaaccacgagtttggaagtacttacattgaaattatagccaccgaaccttgcttttatatttctttaatcgtctcgtggatcttgagtgtttcgatcatttctgaacctcgatgaagaaccggtctccctgtttctgggcctttgatcataccgttgattatcctgctttgatcgtgagtcttttcctgcaggtcccatatatggatcgtacctattcttacctgatctcttttcggtctatgacctcctggaactactcctttcttcatgatgagattgaggaagagtatctttcttaattcacagcttcgtactgtacctgttataaacattattccacgtagttgcaggaaattcgtgaagactttccttaagccttctcgtggcttctaagcttttgtcatttaaattacttgcaaaagctattgcagcccaattatcaggaacgcgaggcaaagtcattctttcacgttggaatctatcaacaaaatccctaagcaactcagagtccccttgtttgattttgaaaatatcttccattcatttcttatccttttgagctcccgagtgtgctttaataaaagaatctgcaagctcagcaaaagaatttatagaattttcaggtaaaagagaataccaggttagtgcacccttggttagtgtttctccaaatttcttgaccagtactgattcaatttcttgtttggtcaagtcattgcctttcacgcctgttgtaaatgcattcacgtgatcacgtggatctgttgtaccattatattttgggatgtcgggcattttgaactttttaggaattggaaggggagcagcacttggcttccaaggttgttgtgaatatttatccatatccactcctttgatcacaggtggaactccagggatttgctctatgtgttcattttgttccttaagatttttctgcaaggttaatactaaattttgccaatgagaagtagttgaattacctggttcacctttatgtgattcacttggtgcatttccagaattaactaatccagaatagggattttccaatgtgttgtcattcggtgttgaaggtaccgcaggtaatcgactgattagagcttctaaagctttgtcaacccgtgcatcaattatcttttgtaaagcctcatctctcccatcaacatgttcagattgatcattaggagtgccatcacgagatccacgtggagaaccttgaggagaaagttcgtctcattgatctccatccacttgatgtgtttgattttcaagaatgttttcgttgttgtttgacatgatgataacaacatgtagaatgtaatttaaaaagaatagattattagatttccgttaacggaactaatttatttaaccaaaaatctgagtctttggtcaaagctagcaataaagaaaaattctggttactgataatcaggagacgaaaataatcgaagacttttgagaataataataaagcagtaaatagttttgtatttcagtgtaatctcgatagtttttcgtgtccttacagatgttgagaccttctccttttatagttgattataggagaatgtgtaatgccttactcttaatgaggcaattatgagcaataaataacattaaaagaaacgttacacaatcattcctattaaatataaattctctaacgtatttgatatttaatattgaatttgtactcttttacgtcatcagattcatatcttcaatcccttccgatcttcggactttaaatgactcgaataggtacgagattcgtgccttttgagtatcgactcgtgcctatttaactttcttctttccgtatttgttgtcgcccgtgcctcttggctgattatcgtattttaactacttgaccagtccacgttgtattgggaaaaagctgagtttatattaaatgtgacgtggcatgacacgtggaccaattaaaggcttaatagacggaagcagggtaagagatacgagcaatgataggcacgggaggaagaactcaagacatgcacgggcatagtccagataggtaccccgtacctaagtaaggcatttaagaccaaagatttgtaaaggttcagaaggcatgaacctggtaacaaaaagcggtccaaatacaatattaaataccgaatacgttagtgaattagaatttaatggcaatgattgtgtaacgcctgattaaatgtccgttattattctcatttaaattaagaaagcaagccgttactcctcagaatctataaaaggaggaggtttcatcatttgtaagggcacgagacaactgagattatattgaaacattattttcttttcttctttatcattatttccaaaaagctctattatttctgtctcctaattatcagtaaaccgatatttcatattaaattcaagttttggccaaagaactattttttggttaaacaaattggttctgttaccgggaatctgataatcaaatcttccaatatatttcatttgttatcataatcatgtcaaacaacaacgacatcattcctggaaatcaaacaggtcaagaacacgatggtcaataagaagatcaacatgacattccttcacatcataattctccacgtggaacccgtactcccaacgatgaatctgaatacgtggatggaaggaacgaaaatatgaatggaaatgcaactatagctgaaatagttgatgcacgggtcgaaagggctttagaagctatactcagaagactgcatgctgcaccgtcaactccaaatggtaatacattggagaacccttgttcaggattaattaattctagtactgttccaagcgaatcacacgaaggtgaaccaggtaactcttctgtttctcattggcaaaatttagtactaaccttgcagcagcagcttaaggaacaaagtgagcgcatcgagcaaattcctggagtcccacctgcaatcaagggagtagatatagacaaatactctcaacagccctggaaatcatcggctgctccactaccaattcccaaaaagtttaaaatgcccgacatcccaaagtatgatggtacaacagatccacgtgaccatgtgactgcatatacaactggtgtaaaaggcaatgatttaaccaagcaagaaattgaatcggtgctggtcaagaaatttggtgaaacactcaccaagggtgcactaacttggtactctctcttacctgaaaactctataaattcttttgctgagcttgcagattcctttataaaagcacattcgggagcacaaaaggttgagaaaagaatggaggatatcttcaaaatcaagcaaggggactccgagctactcagagattttgttgatagattccagcgtgagaggatgactttaccgcacgtacctgataattgggcagcaatagcttttgcaagtaatttgaacgacaaaagttcagaagctacgagaaggctaaaagaaagccttcgtgaatttcccgctactacttggaatgatgtctataacaggtatagtacgaagctcagaattgaggaagataccgtgcctcaataccaatgtgaagaaaaaagcgggtccaggaggtcagaagccgaaaagagatctggtaagaatagatacgatccatatatgggacttgcaggtagggactctagagcaaagcaagacaatcaacgataagatcaaagatcaagaaacagggaaaccgggacttcatctagattcagaggtgatcgaagtaaccaggagccacaaaatggtgatagaagtccaagagcacggttcgctggttataatttcaacgtatctgattctgaactcgtagctattctaagaagtatgggtgacaaggtgcggtggccaaaggagatgcggtcaaatccaaataggcgcaatcctgaccattggtgcgaattccacaacgaccacgggcacaaaacatcagaatgcagatttctacaaagtgaggtagatcatttattaaagcaaggatatctcactgaattgtttagtgaaaagggaaagcaggcctatataaaaaataggcaggagccgccaaagccaccatcacccaagagaactgtgagtgtcatcagtggaggtgaagacatttatatagtaacatatacagccgcaaataaggtttcaaaaatgacgatcacacatgggaaacgagtacggcaaaccttagagcaagaaagcataacttttgatgattcagatatggaaggagtcatgacccctcataatgatgccctggtaatatctttacttgtacatgatactaatgtgaaacgagttttgattgatccaggaagttctgcaaatatcattctcctaagagtgttacgggagatgcaaatagaagacaaaatgattccaaaagcccacaccttgagcggattcgataattcaaacgtaataactaaaggtgaggtaacactaacaacatttgcagaaggtgttacgaaagaaactaaatttcaggtggtggaaatggacatggcatataatataattatggggagaccctggattcatgatatggatgttgttccatctactttacatcaagtcatgaagttcccgtcaccatggggaatttgcaaaatatgtggggagcagcttacagcaaggaccatcaatgctataacagacatgagcatcgcaaataaagaaaaatagcaattacagaaaacagttgaggataccatgattcaaacctcagctgagcaagaacggacagatctagattcaaggcctgatgtaatacaagaacccgaggaaaacgagaacatcaaaacaacaatagaagaactcgaagctgtggtattatttgaacagtggcctgaacggaaggtttacgtgggtgccaacctaaatcctgaaatgcgaggtatgataattgaatttttaaaaactaatgtggactgctttgcttggtcccatgctgacatgacaggtataccaccgcacgtgatgactcataaactcaacgaggacccatcctttactccaatcaagcaaaagaaaaggaaacacggggctttcaaaaatcaagtaatccaagatgaggtccaaaaattgttaaaaattgggtcgatccgcgaggtaaaatatcccaattggctagcaaatacggtggtcgtacctaagaagaacggtaagtggcgagtttgtgcagattacactgatctaaacaaagcttgcccaaaagactcttttcctttaccgcatatagatcaattgattgatgcaactgcaggtcatgagcttttaagttttttagatgcatattcggggtacaaccaaattaaaatggaacccagtgatgaagaaaagacttctttcatcacagaccgagggacttactattacaaagttatgccctttggtctaaaaaatgctggagcaacctatcaaaggttggtcaccaaaatgtttcgagaacatttaggtaaaactatggaagtatatatagacgatatgctcatcaaaacccaacattccaatgatcatatctctcatttaaaagtaacctttgaaattttgcgaaaattcaatatgaagcttaatcctgaaaaatgtgcatttggagtagcttcaggtaaatttttaggctttcttgtttctaaccgtggtattgaggtaaatccttctcagattaaggcaattgaagaaatacctgatatccttaccaataaaaaggaggttcaaagattaacaagaaggatcgcggctctggggagatttatttcaaaatcttcagaaaagtgcttcaaatttttctctgcacttaaaatcaagatcattttgagtggaatgaagatttccaacaagctcttagaaatttgaaagcttacttatcaaatcctcctctattagcaaaaccaaaggagggtgaaaagctacttatctatttggcagtttcagaagtagcggtaagtgctattttggttcgtgaagaacaaggtaagcaatctcctatttcttatgtaagtaagactttactggatgctgagacaaggtacccacaattaaagaaattagcattagctttaatcatggcatctagaaaattaaggccttattttcagtgtcaccctattgttgttgtcactgcttttccactacgaaatattttgcataaacatgagctgtcagggagactagcaaaatgggctatagaattaagtgaatatgaagtaatttatcagcctagaactgctataaaatcccaagtacttgctgatttcgtagctgattttagtcaaggtatgcatttagaagctgaaaaagagttacaggtttttaatggcgcaaattcggggacttgggtattatttactgatagttcatctaatgtaaagggagcaggcttaggaattgttcttataccacctactggtgaaacaattagacaagctataaaatgtcatcccgtaactaacaatgaagcagagtacgaggctgtcattgcaggtctagaattggcacgagaacttggtatagcacaaattgttatcaaaagcaattcccaactcgtggttaatcaaatgttggggacttatacagccagagaagcacgaatgcaagagtatcttgaaaaggtacgagaattgataaggcaattccaaacatggaaagtgatgcagattccaagagaggagaatgtggaggctgatgctttagctaatctcgcatctgtagcagacatagaaaatgatgcaaatgcttcagttattcatttatttcactccgttcttgaaccagataaaaatgaggtaaattttagtcatttaacatgggattggagaaacgaaatagttacttttttgcagtatggaaccgtccctaatgacaaaacaaaggctcatgcacttcgcaagaaagctgcccgttattgtttgcatcaaggaaatctttatcgaaagatgtttggaggacctttagcaagatgtctcggaccttcacagatggaatatgtaatgagagaaatacatgagggacactgtggaaatcatgtaaggggtaggtcattggttaaaacgttgattcgagcaggatactattggcctaaaatggaagaagaagcaaatgatttcgtatccaaatgtgataaatgtcaaaggtatggaaataatatgcacagaccagctgaacttctcaccctgttatagctccatggcctttcatgaaatggggaatggatatcgtagctccattaccacaagcaaaaggtcaggtaaagtttctactcgtacttactgattacttcactaaatgggtagaagcaggggcattcaaacaggtacgagaaaaagaagttaaagatttcatttggaggaatataatatgccgctttggagtaccaaaagagatcgtatgtgataatggcccacaatttataggagcacaagtcaccaaattctttcaaagttggcaaatcaaaaggataacatcaacaccgtaccatccagtgggtaatggacaaacggaatccacaaacaagattatcatcaacaacctaaagaaaaggttacaagattcaaaaggaaattggcctgaagtgctttttgtcggattttgaatcaaacctccgagtcccgtatatttttctgtttcaggaaaaagaccgaaaggagagaaaacacacaagtgctagaggcttcctacttcaccgctcaaacacttgggggactatgtgatatacacgcaagtttgcgtagaagaatagttacgagcaaacaagatttaaaaagaaaaatcaagctacgagaagtcaagtgtcaaagtggaagatacgaagtcattagcattcatcataatgttctctcctatgagaacaacaaagtcacctctcaaacccttcctaatgtgtaaagatagggtcatgactatgtaccaaaaacaggttatgaaaaagaaaccttgtttattttatatcatgtaaaaaatctgttataagaaaacagttacgagaaagttatagatgtacttcaaatacatgtaatattcaaaaacttattaaaagttcatgaatgaaaactgatcaaagttatttcatacaaaacttgtgtgttcctatctctttcatcgtattataacaccattatgaagttgatacgtcttcttcatttagtgtcgataaataaaagggccctcttttattttccgcatgatgacaaatccatgagaagaatcataaagcatttttcaaaaatataaaagtgctaaactattctataagtcctaagtaaaaataggcaagaatagaatacaaactattctgtaaagtcttgaataaagtaaaaagacgagaataggaagtattaattaaacttaataaacataaaagactaaggaaacacttagtcattaaaagctgtaattgtttttaacaaatgccccattatgagaactggggacttcaccaaaaatcccttaaaattactaagggatcacatcaccaaacaaaaaaagaaggaaaagactaaaattctttcaactgatcactgagggaattggaacatcagaagttgaggcctcactttcataagcaacaacaggctcggtaacaacttctgagggagcagcaacgagagcagtttttgctgagctagaagtattaacatcatcgagggaagcagtagtcacgggaacttcaattcccacagactgtgtagcaatcatttcaccctcggtcatttgaatttcaacttcagctatttcagcagctgcttcagaatttgaaggttcttctgctccaggtgttccaagtgttggagaaataacaatgagttgtgctggagaaggagtatcaacaggttggctaaacttctcaatcgtgtctgaaactttagctaactcagattgcagatcaaaacccccttgagtagcttccaataaaacataatgacgagatctcagaaaagtcaattgaacttcatcattaaaattctctacaagagaattgtactccccttccaagttttcataatctctttttcacacagcaaggtcattcttcattatctactgttcagctaagtgggaatcaagggaagctttaagaacaacatgggaactctccaaagcaagaaccttgtctgaagaaattttcaaatcagcccgagactgatccaagctctgcactagctttttggcatgttcttctttctccttcatgagtgctttgagccctttgatttcttcatttgccttcaacaacgactttgtcaatttttttttatattttacaatttggcttgaagaagccctagcaatggcaagctcagaagttagacttcgttttcgttgttctagctgagttctgctttcttgaagttcttctatattcccctatgcactttcaaattgctccttccagttagtcgcttcaagaagagcatccttgtctactttcctagcttcagaaatagcttttgaagattcacgatcctttctttccaaagttgcaactcttcccattaactcagtcccaataagattggcctaaaaacattagacacaaaagtaaggatttaaagcaaataagaaggcagagtattcaaagaaaaagaaattaccttcagagttgaatgaacaatatcattcattagagttaagcaactatggctcttcatcttcgtcctctctgtttctctaattagaggttcaagccacacgtcagttccaccagtcttagtcttcctcaaaagactatgagtaacaggtacttcaagtgtgaccttcctcatagccatacctctgttacttcttggacccgtttatgatattgttgcagaggaagagggagtaatagatggaggagtagtagaaggggtaaggatagctgaagctacgggagttgaaacaggagcagatgaaacaggcgcgggagctattgaaggaattgaaacaggaacgttcaaataaggagaagaaataaaagatgtcaactcaggtaaggagatactcacggtagatgaaggaataaaaggaatgggagaaagaggaatagatgaagaaagaggaatctcatttaaaatagggccgatatctccactctcaaaaccactaacgaaaagatgatgaggggatcactcgtatctcttgctgtggcatcatcatcatattgaatcaaaacaggctcgagagcggaggtacgagcaggagtttctacatcgtcatcttcaacaaccatgcgtctcctagctctgggcctaattgtcaatgaggtaccttcctcttcttcattctcagtaccagttgactctgtgagcacgtgatttttgcctcacgaaaactactccaaaagaaatcaaaaataaataaattttctttggggtacaatttttagaatttgcgtggcagtttttggataattatttgtatttttgcctgtgaatttttatttttgttttaaattaaaaaatacaaaaaaaaaatacatgttacatgcatatttaggatttaattttgcatttaggaattaattaaaacataatttggttttagaagtgaaaatcacaaaaaatatgtatttttgcatttttagtgtctaatgtcgaatgtgtgattttattttaaatttggtacttaattagtgtgacaattgctattaggaattaattgatatttttgataagttaatttggtttttgtaatttaatttaggattgtagggttttaattttgccaattagaaattaaaagaagaaaagagaagagggtgaaaatttaaaggaaattcggattgggctcaaagaaattcaggcccaaatgcatatcgacccagtccaaaaaccaggtctctgaagccattccagaacgacgccgtattggcgtctccatctctgagccgttgatcaaatcaagcgaacggcccagatcaggccttccgctcatccaaacgatgtcgtattgaggcatttgatctgggccgtccatcccaatctcatcctacgatcccaggccttccccagtacccgacccattccccgtatgagaccgacccagtctcgaacattaaccaaacgacaccgtttcacattggtgaagtgatccaaaccgttgatctcatcagatccaacggtttggactaattccccagcctagtatatattcctaaacctcaccccaccccccggttacccagcttcgtctctctcagagacgacccccatcaaaccctagccgccatggctttcccacaccagaaacccggcggcctgagctccgatggccaccaaaataacacccctaaaccaccaaaccaccctcatcacgaatccaggccccgtttgcttcgaatctcaacggaacgtctcgaatatcaaatcaaagaaccagcctaaaaccttgcctcctccgatggccgccaaaccaacaccataagaccatctggccacccccgttccaaatatgttaaccgtttggctcgaatcatcttccatcttctcgaatcttcattcaaagattcgagccaaacacaaaactatccccatccactccaaactcacaccagacctcctcctaacctccctcacaccctggatgacattggtttggttcgaatctaggcagaaaaccttcgagccctaatctgagccccaagaaccctagaaatctaaagcaggagtctcttccaaattgagggaagatttggggtccagtggaccttagtcgaagtgttcttagtaaagaacactcgattaaggtccgttcgacctcaaaggtgttcgagtctgagttcgaccagggttgtctagtttctgagcttcgaggtaatctttctttttctttgttctatcttctgtgttcgtatctgtttattagtttagtttttgttgatttttcaatttgttttttttttgactgctctgttcatcttctccttcaagacctttttatttggtcaatttttttctgttcgtttgagtgtacgttataagctatattcgatttgaataacttcatcgaatagttagtttatatgtttttctgttcttgtcaatacaatctgaatcgccttgttggtctgttttaattctgattatctgtttcttattgtttgttgtcaattattgtatgtaatcgattcaataagattcgtcgattaactagtttccttgaattccccgttttcggtcaaaaactgctcgaatcacatgtgtgtctgcctgtttttgtttgtttgttgttaaccaatacatattatagtttgtgtagtcgattgcataaatgtcgtcaaatgatttggggccgaatggtgtatatactgatcttaggccattagcttcagggcattgtcaatactgacagtgatcctgcattccgatatagagttcgacttaaaattgtgttaagtttaatccctgtgttcatgtgattttgattcagttccagtttcagttttaatcttgttgagtttttttttattacattaagtttggttttttattcaaattcagttcttttgtttcaattatttttcacctcaggcattcagttgtaggattggatatagctgtagtaatctagtagttcaacctgaaatcagttttaagtgtaaatttatataggttgtaacttcagacttctaagctcagggtagggcagtaatacacatggggttgagggggtaatattgggatttagcagggctattaattaagactatcttaaaatctgatagggggtattaaatgccatttgtttaaagtcaataagggacaagcatgccttaagttaagggagaaattaaggaaaaaagggcactttggttaagtttttcaaagggggcagattctgggattttattttgaaaatgagcagattttccagatttttagttgaaaaatggttagattttggatttggttggtggggaagactttcaaaaaagggaggaagggactgttagtttgagctataaataaagagtcattttgacacaaaagggacggaaatttggacatcagaatttcagaactaaaacagtgagaaataggctgaacttttacactaagaggtcagttagtttgagagaaaaactgaaagtgaggtccctttgttatcgaaattcagtagttctgtgctactgtttcatcagagtcctagttttcttgctgcccctgcttgtggtattgtttgaggttgattggttaggttctcgtttgatttttggtttcaattggttacttggttgttgctgattcctggtgtatctgtttgtggttgattgttctggagttgcaatcgatttattactgatccttgtcgattccgatatatttctgggctgtggtgttgttgctgattagtgctattgccgttgctgttatattgttgttgctgtattactgctgctgttgatctcactcctcttcctgtcgtaattcaatcttccaggtacacttactacactggtgcacaatgtagctgaacatttgaagcatgaatgaataaaagagccttaaagctcgaagatattagttgtagctttatttcttgtacctgtatatgcatatttgttttcttttggctaagttacgtaatcaattactgtgcatcaactaggttcaaatctgtaataatctcacgttgaactcatatactagttaatatcggaatagtactgcggtaagtgcattcggtcagttcagttagcttcattgatctagtaaaaatgtatttgggtagttaaaatggtgtaagtccttgttaattcatatgttcagttaatagttcaatgcaatacaattcctgcaaacaaagtttccttagctctcgattttatattgcaagtttgaaaacgtatagtagcatgtaatcaaatcctaagcagactaggaaggcccaggtccatattatgtcactcgtgcagacctgggcctgcaaaaagtgataaaagcaaaggcccggttccttcaatgcaacctctaatgcagtgtttatagtttaggccaataataacaagcatgtaaataaactaggaacattttattcatttttagagacgcatgtagtaaaaagatgtagtcacttcaggatgatccttgtaaataaattcttttaaaaaataataaacaataataaaagcggttaaaagttaaaatttgtatataagttcaacacgtataaaatcagataaataagctaaatacgacagttgagcgaccgtgctagaaccacggaactcgggaatgcctaacaccttctcccgggttaacagaatttcttatccggatttctggttcgcggactaatacagagtcaatcttttcctcgattcgggattaaaccggtgacttgggacaccctaaatctcccaagtggcgactctgaaataaataaataatcccgtttcgattgtcctttaattggaaaaactcccttgcgccctcgcgggtgtgtaaaaaggaggtgtgacagctctggcgactctgctggggatatacccagaaccactggttcagggttagaattcgagcttgaaataattgttgtctttggcttgtttattatttgatatttttacataatgtgcgcttagtatgtgaaatgatgttttgttaccgctttgatattatctgaactgtatataaactgttacgaaacccttcttctctctaagtcttctggaaatcaaaattgggcatttgcttgacatagcccgcttctttgagatagctgtggtgcttggcacccggtgaaggatttttgtgacacaagttaggcggggaacgtcgtcagttaagtcggaaagcgatgctaccggcaatattggccttcctcggctcgagctgtccgctcgggtaagccaggtctagaacaacacccaagtctaaacctagtataacataacctcatgccggatccctagtaggaaaatgcttatttgcatcacgttgcatttgacttaggggactcaacacaggggttgagtccgtctaggaatagcaacctgaaacaacaaaagaccatcctgttgcatcttgtttgatttatgcatctgtttgttccgacttgcatgctgaccggcttacagtatcgggaaagagagagaaatgacagggtaaagataactactaattttcaaaaccaagtagtgtcgaaatgctgaaaaatgttttgaacaaaaatccaattttaagccagttttatttccctttggcgaactacgccggtttgattctcacagggtgtgggatacgtaggcaacccttatcgggtccaacctcccctattgcaaataaaaaccagaaaatgtcaaaattttattgcctccataagagagtcaggcgatgtcgttttgccaaaatagccaaatgttccctaaaggggacgtcggaaggctgactttgcataaatggccgctttttgacaggtcttaatttttgaccctcacagccttaaattcttcgcccccgaggcgctgaaaggccgtatttgcaaaatcgggtcatttattttaatttggaaaacaagaaaagagtcttgaataaattaggtgacgtcgtttgtcagaaatagccgaatgttcccgaaagggacgccggaaggctaactatgcataaacggccacctttgttcattttttcatattcttggtcggttgaccctcacagccttatattcttcgcccccgaggcgctgaaaggccgtgtttgcaaaaccgggtcatttattttaatttttgaaaaaaaaaacaagaaaaagagtcgtgaataagttaggtgatgttgttttgtcaaaatagccgaatgttcccgaaagggacgccggaaggctgactttgcataaacagccacctttaggtcattttttagattttgaccgattgacccacacagcctttaaatcttcgtccctgaggcgctgaaaggccgtgtttgcaaaactgggtcatttattttaattttgaaaaaaaacaagaaaaagagtcgtgaataagttaggtgatgttgttttgccaaaatagccgaatgttcccgaaagggacgccggaaggctgactttgcataaacagccacctttaggtcattttttagattttgaccgattgacccacacagcctttaaatcttcgtccccgaggcactgaaaggccgtgtttgcaaaaccgggtcatttattttaattttaaaaaaaaaacaagaaaaagagtcgtgaataagttgggtaatgctgttttgtcaaaatagccgaatgttcccgaaagggacgccggaaggctgactttgcataaatagccacctttgggtcatttttttagattttgaccgattgacccacacaacctttaaatcttcatccccgaggcgctgaaaggccgtgattgcaatatcaggtcttttattttaatttgaaaaaaaaaacagagaaaaaaaaagagtcagtgaatgccgtcggatgtgttggtcaaaataagccgagccagtttcggcagtgtattaaaccgttcttgccgagatagccttagagtatctttcagttgtcgaaaggctgttttcgtaaaagaacggacgagtctgtgaaataatcctccgcggcttcaaaaattcaagagaaattgggaaggggtcgcgtttgcaaaaattagccatttggttaaaatcggcctataggggaaggaatctgtcggtttgttcttgagtttgtaaatctttttattagaaaatgtgggttgtttgattttcgagtttgtaggtcatctttaaacctttgaaacccagtttgcttttattataaaaatggaaaattctaaaaaattattttattgttgtttatcttttatgtgtctgaactgcgcaaggtctgattcatgcggggtcatgatacgtaggcaatctacataagattcgaccaccactaaaaaaaaaaaaaagaggagagagaatcagaaataagtgaaagtttagggtgtaattacaagaagccggaatgacgcacgtaactgaagtgaaggcatgatagaccggtttaactgttaggtgcattgcatccctgttatatgtttacctatccgtcaaatgccctaacgctaacgtgatgacttcactttgttgtgttcatatcagaaagggggttggttgtggtaactcctccctgcaaaagcaaagccaaaggacaatggcacaaaacctcagaatcgaatgggttggtaccaatgaccgacaacagttggttgaacggaaccactagttggaaaaagaagtgcaaatgctgagacaacatgtgggagccatgtatcgggcgtggatggatgggaaaacaccaccctcgacaccacctagcttcctggactctgtccttacccatacacggaacccaaggccagatgatcccccacactctccatatatacccgcctatcacaattttcccagccacccgagcagctccatcactcatcctccagctatgtcttcccaaccctactcccctccccaacaacacttctctcccctactcccccgaaatcatacctcattttccaggtacccagctccacaaaaagcctatccacaccagaaacctccagggacaggttttcggggaaatgaggcattcaggaaggagaggctgctgaaacgagcaaaggctatcacccctatcggagaatcttatgcaagtctctttgaaaggctaaagcatgctggccggattgagccgctccccaaatgcgctgaaaatccgcgcgcaaagagctttgatcctactgcacgatgtgcataccactccaatgttagagggcacaacactgagaactgtcataatttgaaaagagaggtagaaagaatgattcgagaagggcggattgtgatcgatgacagtgacatgaagcacgcggttcctcttgggaacctatcaactggagctacaggtgttgaaatgggtattggccttggcaaggatgatgcaacaatcagtagctaaaaggccgtgcttggtgtggaaagacgctccatttttgggtcatctggagaggagcttttggtggtttattttgctgtcatttctgttgtccgggttatttcagggttgtaatccggatattgtcttgtggtcaagccctcttatcctttcattttgtctagcttgtttagtcgtggttgtttgtttaaagtggtctaggtttgctttaggattgtaactgttcgttttgttgtctaaacagtttcaccgttttgtctgatgcaaatttaggtcttttattatctttagtctacttttttgtttagttttgtttacccttttgcttttgttcaacgccgattctagtgacatgacgtgcacgcacaatttacgcctaatcttaaaagttgattgaagtcgttgggagatgagcgggacttttaaaggaaaaataagaacggtattgagatcatttgaagcaagtacaacatagaaagaaaccataaaaccaagttggccaaattgacaggggccgttcgaggtaataaaagtgagagcgttgcccaacggtgctttaaaaaggacaaatgaaaaggcgaatgtgtgaatataattgtcaagtccagcaccatcagaagaggctacaaatctttgtttaattacgttgtttgtgcttggcatgttttgaagattggaatgacgaaggcattttgttctgctatctaaacaccttatccttcgttaccccttttgagccttattttttttctctttcatacccctctttaggaatcagtaaaaaagagtagaagaaacacaaaaatagaaaaaagattaaaaaaaaaagagaaaacaacaaacaacaaaagaaaaaaaaaacaaaaacagaaagtcattagaacaacaaggaattgggaactacgtttgacctgattcctcaaagaggatacgtaggcgcctcacggctcggtcatagtgtaacaaatatcaaaagatacccaagcaagaaactggggcaagttgattccgatggttgtaattttgaacccacgttaatttgttttgagcctttaataccctttctttctagccccatccaaaatcccacattacggtccgaagaaagaccttttgaccagtcttcaaaagatgccaagtcaggcagatggaagtcaagaacgacactctgatccccagcagaaaagactttgatccccagcaaagaagatacatgagagagtcttatcagtaataccccaatccccagctggaaaataatacaaatgagagagtctcatcggtgaaaaccttcacgggcaccttgaggcgactgtgagttgagagaaaagacaaaatgagagaggcttgacagtgaaaaccttcgggcactacaagtcgaataagggtgagaatcagatgtggaatcaccaaacgaagattttgaaagacgattgacgacggaggataggccacatgtgcatgtcatgaccattagagtcggtatccgtgtttgataggtttttatagtttctcttgttaaagagtcatctttttcctttgtttttattctgttcctttttatctttctccttccatagaaaactccccagtagagtctgtcgggtcaaaacaagtgagaaatgacttcaaaatatgccaccagctcccaattaggcaagatgagatctaactggtacatccaagtggtatgagtcaggaaggaacaagcgcaaagccagtgtcaggatatccccagcaagatgagattgacaaaaggaccgacaagtgtcaagaaggatatccccagcaggaatcaaaggttaaagacccgaaggccaaggcccgtggacaaatcaagaaagaacaacgcggagagcgattggcgtgatttgggaaattcatatgagactcaagggtcggggaaattccaattcccgagctatgccacagaagaagggtatccccagtagaaagggtgattttcgtgacacggatgaatgaagaaaatggtttatcagcaaaatattgcaaaatcttcaaagataaatcagctctcacggaaaaggtacggggttagatggaaaacaagggtgagaaatttgtgaataaggaatcatcaagaaggtcggaagttatcagctaggcttcaggatggtcagacagagcagagcatgggaaagagaagaagaaagccatcccagcaggagtatcacaaccaaccaccccgttttaaactaaccaaattttctttgatgtgaaacagggacgtgaaatgtcattgatgatagaaagacatgaagattatcaaactggggcagaaaattttcttttcattttcgaaaattttctggaaagtaggtatccacttggggaaagaagaaaggaaaactcatccctagcagaataatccccaacaagtgttgataagtgtgatgaaacatggaacggggaagagagaaagggaaaaaccatccccagcaggaatggcacggccactcacctcgttttaaactaacaatattttctttgatatgaaacaggaagatgatagcataaagtcatgccacaaggaagatcactaaaaactggggcagaaaattttctgccattgttgaaaattttctcgaaggaacaaggaaatcaattactgatgttaaattgaagaaatcaggagcccgcctgaagagaggaatggcatgttattttcaaaagatgttgttgaagtcaggagcccgcctgaagagaggagaggcgagtttattttcaaagttgttgattgaagtcaggagcctgcctgaagagaggaatgacatgttattttcaaaagatgttgttgaagtcatgagcccgcctgaagagaggcgaggctagtttattttcaaagttgttgaagaagtcaggagcccgcctgaacagaggagaggcgagtttattttcaaagttgttgattgaagtcaggagcccgcctgaagagaggaatgaaatgttattttcaaaagatgttgttgaagtcaggagcccgcctgaagagaggagaggctagtttattttcaaagttgttgaagaagtcaggagcccgcctgaagagaggaaaggcgtgtttattttcaaagttgttgttaaagtcaggagcccgcctgaagagaggaatggcatgttattttcaaaagatgttgttgaagtcaggagcccgcctgaagagaggaaaggcattttattttcaaaaaatgttgttgaaagttgggagcccgcccgtagaacggaggcattattttcaagttattgcattcgggagcccgcccgtagaacggaggtgttattttcaagttgttacattcgggagcccgcccgtagaacggaggcgttacatttcaagtttctacattccatgtcctaaaaatcagtaacccactagaaggcagaaggttataacaaaaatccccagtagaaattgaagtgcagaaatcaaaataagacaaatctcaagagaagcggttttcgaaccaatgttattcccagcacagcaagttttaatgaaggaagcgatatccccagcggacagagcaaaatgatgaaacttgtgttcagaaaaagcaaaaggccagtgtcctccccgtcagtttgcgaaagaaagaagcaccagaggaaatacaagccgacaagaaagcaaggcaacaagagaaaattgaagatagataagatcttgtaacccttagtctagtctagcttcttgtgtttcttttgacacggtgtaataaggagatcagtaaagcggtggtaacagcttacagcagtagtaacagcaaaatgcaatcccacggtagtcccagctaccaaaacttcccgaactacattaacctgattccctttcagccagggatatgtagaaaacctttgaagcaaaggttcggttaaaacctttttcaaaaaatgcttcacacggagtattccaacgggcaaaaatcgctcgtattcgctcactttatctttgcacgaaaactctttgtgttttcgaacaaagaggggcagctgtgagcacgtgattttttcctcacgaaaactactccaaaagaaatcaaaaataaaataaattttctttggggtacaatttttagaatttgcgtggcagtttttggataattatttgtatttttgcctgtgaatgtttatttttgttttaaattaaaaaatacaaaaaaaatacatgtaacatgcatatttaggatttaattttgcatttaggaattaattaaaacataatttggttttagaagtgaaaatcacaaaaaaatatgtatttttgcatttttagtgtctaatgtcgaatgtgtgattttattttaaatttggtacttaattagtgtgataatttctattaggaattaattgatatttttgataagttaatttggtttttgtaatttaatttaggattgtagggttttaattttgccaattagaaattaaaagaagaaaagagaagagggtgaaaatttaaaggaaattcggattgggctcaaagaaattcaggcccaaatgcatatcgacccagtccaaaaaccaggtctctgaagccattcccaaacgacgccgtattggcgtctccatctctgagtcgttgatcaaatcaagcgaacggcccagatcaggccttccgctcatccaaacgacgtcgtattgaggcatttgatctgggccgtccatcccaatctcatcctacgatcccaggccttccccagtacccgacccattctccgtatgagaccgacccagtctcgaacattaaccaaacgacaccgtttcacattggtgaagtgatccaaaccgttgatctcatcagatccaacggtttggactaattccccagcctagtatatattcctaaacctcaccccaccccccaagccactacccccggttccccagcttcgtctctctcagagatgacccccatcaaaccctagccgccatggctttcccacaccagaaacccggcggcctgagctccgatggccaccaaaataacacccctaaaccaccaaaccaccctcatcacgaatccaggctccgtttgcttcgaatctcaacggaacgtctcgaatatcaaatcaaagaaccagcctaaaaccttgcctcctccgatggccgccaaaccaacaccataagaccatctggccacccccgttccaaatatgttaaccgtttggctcgaatcatcttccatcttctcgaatcttcattcaaagattcgagccaaacacaaaactatccccatccactccaaactcacaccagacctccttctaacctccctcacaccctggatgacattggtttgttcgaatctaggcagaaaaccttcgagccctaatctgagccccaagaaccctagaaatctaaagcaggagtctcttccaaattgagggaagatttggggtccagtggaccttagtcgaagtgttcttagtaaagaacactcgattaaggtccgttcgacctcaaaggtgttcgagtctgagttcgaccagggttgtctagtttctgagcttcgaggtaatctttctttttctttgttctatcttctgtgttcgtatctgtttattagtttagtttttgttgatttttcaattttttttttaatttttttttttgactgctctgttcatcttctccttcaagtcctttttatttggtcaattttttctgttcgtttgagtgtacgttataagctatattcgatttgaataacttcgtcgaatagttagtttataagtttttctgttcttgtcaatacaatctgaatcgccttgttggtctgttttaattctgattatctgtttcttattgtttgttgtcaattattgtatgtaatcgattcaataagattcgtcgattaactagtttccttgaattcctagttttcggtcaaaaactgctcgaatcacatgtgtgtctgcctgtttttgtttgtttgttgttaaccaatacatattatagtttgtgtagtcgattgcataaatgtcgtcaaatgatttggggccgaatggtgtatatactgatcttaggccattagcttcagggcattgtcaatactgacagtgatcctgcattccgatatagagttcgacttagaattgtgttaagtttaatccctgtgttcatgtgattttgattcagttccagtttcagttttaatcttgttgagtttttttttattacattaagtttggtttttgattcaaattcagttcttttgtttcaattatttttcacctcaggcattcagttgtaggattggatatagctgtagtaatctagtagttcaacctgaaatcagttttaagtgtaaatttatataggttgtaacttcagacttctaagctcagggtagggcagtaattgtcacgaccctagttcaccaatcgtgaacctgtcatgacggcacctagtcttcacgactaggtaagcctaactcattgcggaatcaacaacactatcataaaataaatacagaatgctaaataccataagagatgtataaaggtgccacttagcacatacactttaacacaaaatcgaatcaactcccaaaatccggaatctcacaaatcacaagctagggggaaaaatacatatggctctgactcgagaatatctatacaaggagaatactggaagaaacaacactattacagaagctgggaagggactcctcggtctgcggacgcagcagacatacctcgaagtctctaccgaacacgcctccttccaaggcggacagaactgaatgggggtacctgtatctgcacaacaaaaatgtgcagaagagtagcatgagcacaccacagcggtgtccagtaagtatcaagactaacctcggtggggtagtgacgaggaacagtcgagacacctaccggtcaataaacaggataatcatatgaataatgaagacgatatatgtaatcgtgtaaagactgtataaatgactaaaagtgctacaactcacaataaggcggaaggcaacaagtaacaacgagaacataataaatgatgatacgaatgaaggccgaatcacaatccaaagcctaaggtcgcaacatagcaagaacagcaagttaccaatttatatattacgatgatgcttaccaaaaggtcttaatcaactcttcccacaatcattaccaacacttcggacaaaccacaactcacgagaaaacccaacgtctgtagtctaacaccggcaacctatgcccataaatctcacggtcatgctgacaactaaccggcataactagggttgctctcatatatatatatatataatggacgcacgagggcgtatctccacccttagccaaattggaaggaattcacctctaatggggtgtccaactacgtgtatgcttgtgcaagtgtgaccagcaaggatcctaccaactagtaggtataagaaataacacggccatcgcccgaaatagttgcacaattacagcaattcaaaacagaatatacctgtcagcaacaactgaacgaaatacagaaatagcacgaaaaggtgcaactcaatgccaatgatgccataaggatctcccaggataccgtcctgtagtcctttctcaactgtccagtggatctcccgggataccgtcccgtagtccaatatatcaatcatatccgaaggatctcccgggatcccgtcccgtagtccaacatatcaatcatatccgaaggatctcccgggatgccgtcccgtagtccaacatatcaatcatatctgaaggatctcccgggataccgtcccgtagtccaacatatcattacccagtactgggggaactaccaggtgcattcctgtagttccatacaactgtgcagggggagctaccggaatcccacatccgtagtcccaaaataaataacagggggagctaccggaatcccacatccgtagtcccaaaataaacagacaagggggaactcccggaataccacatccgtagtcccaatgtaaatgcacaccaacagcaagagaacaacaacatcccagcaagggagtcaacaacagatacaacaagtcccgacaagggaatcaacaatgagaacaacaacgtcccgacaagggagaaacaatgaagtaataacgtcccggcaagggaatcaacaatacaaaaggaggatcacggaaaaaccaataagcacaataacctcaataagaatatcaagacatgaagtgcatgctagctacaccggtaaccacaacagttggacgtatcacctatttgcacgtagtcacagatgaatttacgatcaaggagtatccaacaataaggaagttcacatgggacaattaattacaattaggaaattatcaattaaacttaggatatctaacttctttccaattaaggtcggataagtgtcatgagaagtaaggataatgatttccaattaggggcaagcggtttggagaggtaacgtggttatataagggtaaacgttcccagctaaacaagtagaagtcaactaggcagcaagaataaccaaaagagcaaataaattccaggtaagacatgttgaagtgaaactaataacggggaaacttaatcatattaagaacaacttcatactcggtgaattcaaaggtctaagagcctaaaaggatcaaattaccacaaataaatccgagcacacactcgtcacctcgcgtgcaaggaatacaatcaacacagaagactcaaatcctaatgggaagttccccacacaaggttaggcaaaatacttacctcaaaccggctaaaatcaactagcaaccacgttcttgccacgagttctcgactccaaatggcccaaatctattcaattaaaccacaaattgtaaataatatctcaagcaactgattctacaatttaattcaaagctaaagcgcgaaattaggtaaaatgaccaaaatgcccctcgggccaacgtctcggaatcagaatatttttacattttcagaagcctcgcgctctcacgagtctaaccatataaaattcacccaaatcggaggtcaaatggtccttcaaatcatcaaagttaggtctaagaacttgaccccaattttcatgccaaatccgaaattaaagcttgaattcgagtttagattagcgggtaatgatcaaaatagagtaaggaattgttaccccgatgtttgcctctgaaaacccttcgagaaatcactccaaaccgagctctctaacttgagttttcacaaaaatggaagaagggttcgtatttgaaatgtttatactgcccagcgacttaatgaatcgcgatcgcaaatatagggacgcgatcacggagagtaaaaatggaggctcaggagaaaggtctacgcgatcgcggaacaacgcatgcgatcgcgttcaagggggaactgaccttacgcgatcgcgtggcatgggatgcgaacgcgtaagaggggaaggcaacggtacgcgatcgcgaatggatctctgcgatcgcgaagaaggaaaaagggaccctccccatttggtctatgcgatcgcggagaggaaaagtactctgcaacagctgaaggatttctgcacttagaaaaattccggaaaggctccgttgagcatccgaaacacacccgaggcccccgggacctcaaccaaacctacgaacatatcccataacatcagttgaacttgtaccaatccttaaatcgcctaaaacaacaccggaaacgtgaattaatcattgacttgaacttagaaatttcaaaacttaaccaaaatcataaccgatgccgaaactaatcaaacgaggtccgaatgacctgaaaatttgcacacacatcccaattcacctaacgaagctactgccgctttcggaattccattctgagccccggatcagattttcacatatcaaccggatattccaaatttccaactttcggcatttctaggctaattgagctacggacatccaaacaacaatccggacacgctcccaaccccgaaatcacctaacggagctaacgggaccatcggatttccattccgaggtcgtcttgacactgttccgactacgggccattttccaacacttaagttctcaaatagggactatttgtcccaaaacactccggattcaactgccgaacatcccggcaaaccaaaatagcataaataaacttaggggaagcagttaacggggaaacggggcgcaaattctaaaaacgaccggccgggtcgttacatcctcccacacttaaacattcgttcgtcctcgaacgagccaagattcgcctcgaagtcctcaagtcactgagcgtgcacttccaacatacacccgcgggtgatccctcgtcacccaatccactccaggcatgacgacaccatctcaactgaaatttaacctttctagtaataccaataagccttcaaaccaaaaatattcaccttccatccaatttcaaaagacccgattccaaatctataaccgatattgatctcgaccagctattttaatacaagccaacacacacagggtacgaccacacagcatgacacaccacacataggcccacaatgatatttctgatagcaatacttgtctgagatcaactctacactggccttaagcctcatattcaatggaaactcttttcccaaccaccacaacactggcgataatacaatagctgtgaaaccacataacaaaacacccgaataaccaagtctcagccaacacaatcgggtgcacaccccacaactaaaactcaagaagcatagaatggcaatgaataatacgggaaaggaaaacacataaaggaatttaacaaacaaatcgaactagcataaatgcttctaaaacacaaatctacaaagatatctaacaagaaggaatgaaaacatataaaagactcacgaggatctcatactgatataactctcaccgcggcacacagcccggtatcaacgtgtcaaaacacctgaaatcacgagggttctgccctccatcactgaatcacaagtagggctcatactaacccatctagaaactctcactagatcaattctgtctatgatttacaacacatactggctcccacaccggtggagcatagaaatcacagctcgtaagcaagaacacccaaaagtgacatcaacctatcaaaacaaacaacaggaatttactactagcctcatagctctcgacagcaactggaaacaaacgatagacacggctatcactcatagcacctcccaacaggttaattacacaaatagagtgcaaatcatgaagcactccaatgaatggaacaacatacaagggactcaacctgataagtagaattgtgatgaattacagatagtgtctctctataacaatctgaattggcacccgaaggacattagctggcacaccggcctcaaatctactatatgaaacacattaacgagccgggcctccccctcttgggcgccctatacctgcctgaatacctcgctgcgacaccacggtccgaagtctgagacaatctctcaccatgtggctaatacctccctactcgaggcaccctctccgctgacaaggcgggaaactgtgcgatacgggtactctgagacccatgaacacctgaatcaccatgcaaggcctgaacgcgaactgaaccggctgacccgtagacttccatcatgacgtaccctgcctcccaatcaaggaccagtatatcccaccggtctacgacgcctcctcgcctcctcgcctcctcaagatatctctcttgatctcgttcaatttctctctcatgatcctgcctgccctctccctctggcatgcataccctctatcccccaagcaatgtttatcaccggctgatatagaatatccatccctaactcacaagccatactgggcctgatgttaggaataagtccctcaataaaccggcgaaccttctcacgaacagaagaaaccaaggccgaggcttgtctagccaaactggtgtaaaagggacaacatactccgagacggtcataacaccctggcgcaatgctcaaactccacgcgccatgcatccctgaggcgctaaggagcaactctcgcagaacatatctgaaactaggtccaagtcagtggagctacctcctctgggctggctaactcataggtgcaccaccaattataggcggctcctcaatgctggaaagtggtgacagaaccccgctcgatccggagatactcatggtacgaagaatacggtaacactcttcaagaaatcccaaagcactgtctgatgttagtccactgaacaccggaaaaatcatactccttgaacctctctagtcacatctacttatactcagaagccgctatcatgccctcgggctgaactggtgctgcaggcggcacgggaataatctcagggacctgctcaacatgcgctcgctgcttagaagtgcgggcggcgggagtctgtgctcctcccccggtctggggtgtgactgcagcaagggaaagcaatcctgcttgagccaaggtagtgtacatactcacgaattgtgccaaatctcctggaggactagtgtagtagtagctgtaggcgtgccgggtgcctggactccggctgaatctgcgggtgatacctcagtggcagctcgcgcaggtgctctcgctgcaccacgtgcgcgtcttcgacctccatcccggcactgaccttcgacggctgcagcaaggggcgcgggtgtctgatcacctcgagtagtacgtgtcctcaccatggtgagagagtggaaaacagaggcttagaattgtcaatgtcaaaatctcgcacgacagggaaatcaaatgaagtggaatttccctaacagttacatagcctctcgcggataagtacagacgtctccgtaccgatccacgagactctaataaaccggcttgtgatatgtgactcctatgaacctagagctctgataccaacctgtcacgaccctagttcaccaatcgtgaacctgtcatgacggcacctagtcttcacgactaggtaagcctaactcattgcggaatcaacaacactatcataaaataaatacagaatgctaaataccataagagatgtataaaggtgccacttagcatatacactttaacacaaaaccgaatcaactcccaaaatccggaatctcacaaatcacaagctagggggaaaaatacatatggctctgactcgagaatatctatacaagtagaatactggaagaaacaacactattacagaagctgggaagggactcctcggtctgcggacgcagcagacatacctcgaagtctctaccgaacacgcctccttccaaggcggacagtactgaatgggggtacctgtatctgcacaacaaaaatgtgcggaagagtagcatgagcactccacagcggtgcccagtatgtatcaagactaacctcggtggggtagtgacgaggaacagtcgagatacctaccggtcaataaacaggataatcatatgaataatgaagacgatatatgtaatcgtgtaaagactgtataaatgactaaaagtgctacaactcacaataaggcggaaggcaacaagtaacaacgagaacataataaatgatgatacgaatgaaggccgaatcacaatccaaagcctaaggtcgcaacatagcaagaacagcaagttaccaatttatatattacgatgatgcttaccaaaaggtcttaatcaactcttcccacaatcattaccaacacttcggacaaaccacaactcacgagaaaacccaacgtctgtagtctaacaccggcaacctatgcccataaatctcacggtcatgctgacaactaaccggcataactagggttgctctcatatatatatatatatataatggacgcacgagggcgtatctccacccttagccaaattggaaggaattcacctctaatggggtgtccaactacgtgtatgcttgtgcaagtgtgaacagcaaggatcctaccaactagtaggtataagaaataacacggccatcgcccgaaatagttgcacaattacagcaattcaaaatagaatatacctgtcagcaacaactgaacgaaatacagaaatagcacgaaaaggtgcaactcaatgccaatgatgccataaggatctcccaggataccgtcctgtagtcctttctcaactgtccagtggatctcccgggataccgtcccgtagtccaacatatcaatcatatccgaaggatctcccgggataccgtcccgtagtccaacatatcattacccagtactggggaaatctaccaggtgcattcctgtagttccatacaactgtgcagggggagctaccggaatcccacatccgtagtcccaaaataaataacagggggagctaccggaatcccacatccgtagtcccaaaataaacagacaagggggaactcccggaataccacatccgtagtcccaatgtaaatgcacaccgacagcaagagaacaacatcccagcaagggagtcaacaacagatacaacaagtcccgacaagggaatcaacaataagaacaacaacgtaccggcaagggagcaacaatgaagtaataacgtcccggcaagggaatcaacaatacaaaaggaggatcacgaaaaaaaccaataagtacaataacctcaacaagaatatcaagacatgaagtgcatgatagctacaccggtaaccacaacagttggacgtatcacctacttgcacgtagtcccagatgaatttacgatcaaggagtatccaaccataaggaagttcacatgggacaattaattacagttaggaaattatcaattaaacttaggatatctaacttcttttcaattaaggtcggataagtgtcatgagaagtaaggataatgatttccaattaggggcaagcggtttggagaggtaacgtgactatataagggtaaacgttcccagctaaacaagtagaagtcaactaggcagcaagaataaccaaaagggcaaataaattacaagtaagacatgttgaagagaaactaataacggagaaacttaatcatatcaagaacaacttcatactcggtgaattctaaggtccaagagcctaaaagggatcactttatcacaaataaatccgagcacacactcgtcacctcgcgtgcaaggaatacaatcaacacagaagactcaaatcctaaggggaagtcctccacacaaggttaggcaagatacttacctcaaaaccggctaaatcaactagaaccacgttcttgccatgagctcccgactccaaatggcccaaatctattcaattaagtcacatattgtaaataacatctcaagcaactgattctacaatttaattcaaagctaaagagcgaaattaagtaaaatgaccaaaatgcccctcgggccaacatctcggaatcagaatatttttacattttcagaagcctcgcgctctcacgagtctaaccatataaaattcacccaaatcggaggtcaaatggtccttcaaatcatcaaagttaggtctaagaacttaacaccaatttttatgccaaatccgaaattaaagcttgaattcgagtttagattagcgggtaatgatcaaaatagagtaaggaattgttacccgatgttgcctctgaaaacccttcgagaaatcactccaaaccgagctctctaacttgagttttcacaaaaatggaagaagggttcgtatttgaaatgtttatactgctcaccgacttaatgaatcgcgatcgcaaatatagggacgcgatcgcggagagtaaaaatggaggctcaggagaaaggtctacgcgatcgcggaacaacgcatgcgatcgcgttcaagggggaactggccttacgcgatcgcgtggcatgggatgcgaacgcgtaagaggggaaggcaacggtacgcgatcgcgaatggatccctgcgatcgcgaagaaggaaaaagggaccctccccatttggtctatgcgatcgcgtgaggaagcacgcgatcgcggagaggaaaagtactctgcaacagctgaaggatttctgcacttagaaaaattccggaaaggctccgttgagcatccgaaacacacccgaggcccccgggacctcaaccaaacctacgaacatatcccataacatcagttgaacttgtaccaatccttaaatcgcctaaaacaacaccggaaacgtgaattaatcattgacttgaacttagaaatttcaaaacttaaccaaaatcataaccgatgccgaaactaatcaaacaaggtccgaatgtcctgaaaatttgcacacacatcccaagtcacctaacgaagctactgccactttcggaattccattccgagccctggattagattttcacttatcaaccggatattccaaatttccaactttcggcatttctaggctaattgagctacggacatccaaacaacaatctggacacgctcccaaccccgaaatcacctaacggagctaacgggaccatcggatttccattccaaggtcgtcttgacactgttccgactacgggccattttccaacacttaagttctcaaatagggactatttgtcccaaaacactccggattcaactgccgaacatcccggcaaaccaaaatagcataaataaacttaggggaagcagttaacggggaaacggggcacaaattctaaaaacgaccggccgggtcgttacagtaatacacatggggttgagggggtaatattgggatttagcagggctattaattaagactatcttaaaatctgatagggggtattaaatgccatttgtttaaagtcaataagggacaagcatgccttaagttaagggagaaattaaggaaaaaagggcactttggttaagtttttcaaagggggcagattctgggattttattttgaaaatgagcagattttccagatttttagttgaaaaatggttagattttggatttggttggtggggaagactttcaaaaaagggaggaagggactgttagtttgagctataaataaagagtcattttgacacaaaagggacggaaatttggacatcagaatttcagaactaaaacagtgagaaataggctgaacttttacactaagaggtcagttagtttgagagaaaaactgaaagtgaggtccctttgttatcgaaattcagtagttctgtgctactgtttcatcagagtcctagttttcttgctgccccttcttgtggtattgtttgaggttgattggttaggttctcgtttgatttttggtttcaattggttacttggttgttgctgattcctggtgtatctgtttatggttgattgttctggagttgaaatcgatttattactgatccttgtcgattccgatatatttctgggctgtggtgttgttgctgattagtgctattgccgttgttgttatattgttgttgctgtattactgctgctgttgatctcactcctcttcctgtcgtaattcaatcttccaggtacacttactacactggtgcacaatgtagctgaacatttgaagcatgaatgaataaaagagccttaaagctcgaagatattagttgtagctttatttcttgtacctgtatatgcatatttgttttcttttggctaagttacgtaatcaattacagtgcatcaactaggttcaaatatgtaataatctcacgttgaactcatatactagttaatatcggaatagtactatagtaagtgcattcggtcagttcagttagcttcattgatctagtaaaaatgtatttgggtagttaaaatggtgtaagtccttgttaattcatatgttcagttaatagttcaatgcaatacaattcctgcaaacaaagtttccttagctctcgattttatattgcaagtttgaaaacgtatagtagcatgtaatcaaatcctaagcagactaggaaggcccaggtccatattatgtcactcgtgcggacctgggcctgcaaaaagtgataaaagcaaaggcccggttccttcaatgcaacctctaatgcagtgtttatagtttaggccaataataacaagcatgtaaataaactaggaactttttattcatttttagagacgcatgtagtaaaaagatgtagtcacttcaggatgatccttgtaaataaattcttttaaaaaataataaacaataataaaagcggttaaaagttaaaatttgtatataagttcaacacgtataaaatcagataaataagctaaatacgacagttaagcgaccgtgctagaaccacggaactcgggaatgcctaacaccttctcccgggttaacagaattccttatccggatttctggttcgcggactgtaatacagagtcaatcttttcctcgattcgggattaaaccggtgacttgggacaccctaaatctcccaagtggcgactctgaaataaataaataatcccgtttcgattgtcctttaattggaaaaactcccttgcgccctcgcgggtgcgtaaaaaggaggtgtgacagaccccatctttctctttgctgcaatcaagacttttgccttatctaaatcaatagcagcgttggcagaagtgcgaatagccaaagccacgacagcagtcattccttttatgctaaatcctaataaaaagagggatgagaattaattattgaaaataaaaaggtttactaaatgtatcaggcaatgtgcataccatgagttttcactttccaaccgttcaaagaagaaatggacttccaagtcctatcttcctttggagcaatttttaaaattgtatctacccaaccacggaagttggaaataggttccacatctcccatagttgctacaaaaaaccaataagggaagaaattaggaaagagaaaatcaaagtattggaaaaatagacacagtaaagtaaacaaaaacttacgtgcaaagttccacttctcagggaagggaatgtttgattcacccaacagatccgaagtacgaatgtcaacatatagaaggtaccacccacggtccttatcatcctcagggtttaccaaaaccttcttactccatgcagttaaggtaaaaacctcgtgacgcaacaagttagggtggtacaagtgaataaggtgagaaagtgtaaaatccatcttagccttggaagaaagatgtctcaaacaatatactgccctccacactaatgggccaacttgggccaaacaaatgtcaaaaaaatgacagaaatcaagaataactgggtctacagcaggtttaaatcccaaagtaaagggataagtataaacaaaagaataacctctcctataagatgaaatcctttattgtatagtggggaaagacaaacgaaaactatctttccaattgcaatcctttctaatggtagggagtgtaagttcagttataagggaaggataatcatcaaccttttctattttctcaatctgcttctgaagagatagtttgtcacccacaaaggacaggtcatttggtactatttcttctactaaaggttcttgggaagagtcagaaatttctttacctttggaagaaggggttttagaagtggaacctttagcgcctgaatttagggaaggagaaacagagacagtcgaaccgcctcgaatggatccagaactccgaagtctaccaccactgcctcttctatgcctgacaactgaagcaggggcattggaaaattgatcaagaagttgaacttttctagggttagggtttggagataccattactaaataagcacaagttcgagagaagtaaaaagaaaataaggagacacttgatggaagtttatgaagaaggtgacaaagaaagagagaattaaagaagtatatagaagcaaccgtcaaactaagaagaataatgatggaaagcctatattaaaggcaactatcacttcgtgaaaagaggggttgaataagcctagaaagaaggaagcagaattgcagatccaatcgggagatgacacgtgtgtggagcattaaatgtgaaagacagtttaggcgtcagtattgtcataagcattaattatggcaaaaattctctttttgagaagatccacttcccaattatttaatggataaataaaagaaaagtggggggactatctgtattgggaaaaaattgagtttatattaaatgtgatgtggcatgacacatggaccaattaaaggcttaatagacggaagcagggtaagagatacgagcaattataggcacgggaagaagaactcaagacaggcacgggcatagtccagataggtaccccgtacctaagtaaggcatttaagaccaaagatttgtaaaggttcagaaggcatgaacctggtaacaaaaagcggtccaaatatagtattaaataccgaatacgttagtgaattagaatttaatgacaataattatgtaacgcctcattaaatgtccgttattattctcatttaaattaagaaagcaagccgttactccttagaatctataaaaggaggaggtttcatcatttgtaagggcacgagacaactgagattatattgaaacattattttcttttctgctttatcattatttccaaaaagctctattatttctgtctcttgattatcagtaaaccgatatttcatattaaattcaagttttggccaaagaactattttttggttaaacacacgtgtcatgacacgtcatcttcaatatatagactcagttttttcccaatacattaacaccattaattacactagagtatactagtatgtgccaaaatatatcaaatttactatatggtacttaatttgtccatatctccttgctcaaaagggtgggggtggagataacaacaacaacaacaactacccagtatagtcccacaaagtggggtctggggagggtaatatgtagacaggccttacccctacccgaaagggcagagaggctgtttccaagcgaccctcggctcagggaaggaaagaaaaaacaaacaaaacaaaaacaaaagagcattagtaactccagcagcaatcgcgtaatgatatcaaacagtaacgatcataaataactaaacataagaaccataaataaaatggcatgcaataatatcaaacagtaacgaccataactaactatcctaaaggagacacaaaccaatacacaaatcatctatagatagccctgccaagcctcacccaaccccgagaaaggagtacgaaaaattctaggagcccctatcctacaaccctgacactagacctccagactttcctatcaagggccatgtcctcggaaacccgcattctagccatgtcatgcctaatcacctctccccaatacctcttcggcctccctctgcctcgccgcacgccgaccaccgccagccgctcacaacttctcaccggggcatcaggacttctcctccgcacatgcccgaaccacctgagcctcgcttctcgcatcttttcatccaccggggccacccccaccttctctcgaataacttcattcttaatcttatctaacctggtgagcccgcacatccacctgagcatcctcatctccgcaacctttattctctgaacatgagagttcttcaccggccagcactccgccccatacaacatggcaggtctaaccacagctctataaaattttcccttgagtttctgtggaactttcttgtcatacaggactcatgatgcaagcctccacttcgtccaccccgctcctatacgatgagtgacgtccccgtcaatctctccgtccccctgaatcaccgacccaagatatctaaaactgtccctcttagcgatgacctgagatccaatcttcacgtccgtgcctacttcgctcggctcggcgctaaacttgcactccaggtattctgtcttaaatctgcttatttttaaacccttagactcgagagtctgtctccatacctctaacctctcattaacactgaccctcgtctcgtctatcaagactatgtcatcagcaaatagcatacaccaaggcacatccccttgaatatgacgtgttagagcatccatcaccaaggcaaacaagagggggctaagcgccgatccttgatggagccccataaccaccgggaaatggtctgagtcgccacccaccgtcctaaccctggtcttagctccatcgtacatgtccttgattactctgatgtaggcttccggcacgctcttcgcctccaggcacctccatagcacctcccttaggaccttgtcatacgccttctccaagtcgataaacaccatgtgcaggtctctcttcttatccctgaactgttccaccagtctcctgaccaggtggatagcttctgtagtgcagcgacccgacatgaaaccgaactggttcacagatatagatgtcatctccctcaccctcgcctcgatcacccgctcccagaccttcatggtgtgacttattaatttgatacccctatagttgttgcagcactggatatcccctttgttcttgtacaaaggcaccactgtactccacctccactcctccggcatccttttggtcctgaagatcgcattgaacaacctggcgagccactccactcctaacctacccatgcatttccagaactccaccgggatctcatcaggcccggtggctcgacccctactcatcctacgcaaagcccccacgacctcctccaccctaatgcgcctgcagttcccaaggtctctatgttgctctgaatgccccagctcccccagctctatgtttcggtcccccacctcgttaagtaagtctcgaaagtacgcctgccacctctgctttactttagactcccccatcagaaccctaccatcctcgtcattgatgcacctaacttggtcaagatctcgcgccttcctctcccttgctttagctaatcagaataacttcctgtccccacctttttcccctaattcctcgtacatgcgaccaaatgccgcatttttggattccgtaaccgccagcttcgcttttttcctcgccaccttgtagatctccctgttcgctctcctttcttcctcgcttatgctccctgccaacttagcaaacgccgccttcttcacctccacttttccttggactacatcgttccaccaccagtcaccctgatgtctgcctgaatagcccttggctaccccgagcacatcccgtgctacctccctaaccaagttcgccgtctctgaccacattgagtccgcttcccccgaacttctccaggctccgccctcaactaacctcctctccaagtcctgggctttctccttagtcaaagcaccccatctaatccgcggttgtcccagagcacccttcctcttcctcttcacccagagaccgacatccatcactaggagtctatgaagagtcgaaagggactctcccggaataaccttgcagtccttgcacaaacccctatctctccttctgagaaggaggtaatcaatctgagtcctcgccgccgcacttttgaaggtgaccaaatgctcctccctcttctggaatgtcgagttcgcaatcagaagctcggaagccctggcgaaatcaagcagtgacgtgcctcctccgttcctaaccccaaagccgaagccaccgtgcacctcaccataaccaccagcatcagccccaatatgaccactaaagtcccctccaataactaacttcttagattggggaatactacacaccaggtcatccaagccttcccaaaaatgcctcttaacctcctcgtctaagcccgcttgcggcgcgtaagcgctgatgacattgaggacgcaacccccaataaccaacttaatagacattaacctatcattcactcgcctaacctcaatcacagactcccttaaatccctatccaccaagatgcccactccattcttgtgacgacccaatggggtcatcaccgtaatgctcctttatcctgtgcttctgaagcctcgaaaacctcttgaggggttacctcgatttgcgtgcgcagtccgggcgtgaagccggaaagattttatgtgatgtaagttgaattctgtgttaaaaatggtgaatttcaagtataatattaatagagttgactccggtcaacattttgggcaaacgggcccggactcgtgatttatcaatgtctaaatatccgtagtaaaatatgggacttgtgcatatgcccggaattgaattccgaggtcccaggcccaagatacggaattttctgtgaaaatagtttctgaaaataacttgagattatgaaaatgaataattgattttaaactatcgtatcgggctcgtattttggttccgacgcccggtacaggtcttatatggcgtttaagcacttcctgtaaaatttggtcgaaatcggacgtcgtttgacgtgtttcggaccctaaaagctaaattgaaagtttgaagttaaagtttggaaattatggattttatggtttaattctatgattatgatactattttagcgatttgatcgctcgagcgagttcgtaggatgctaatgagttagtatgagtgtttggttgggagccccgagggctcgggagtattttcgggggtggttcgggaagtttttggtcttgttgtgttgtagatttctgcaatttctacccagtggtgcccttctatgcgatcacatggtggtggctgcgatcgcatagagtctcctgtcagccccttcatttttgctctctgcgatcgcagagatagccttgcgatcgcgttcctttggcccgttgttatatgcgatcgcatcccttctattgcgatcgcgtagtgtaattcatgccccaggtcagcccacccttttactcaatccggtcgcagtttggtccctgcgatcgcgtaagcttgaatcccagcactctatgcgatcgcatcatgtgctccgcgatcgcatagagtgatttttgcccagcgattttaagttacagaatactattttggccgagacccttcttccatttttcactcaaactcatttctaaaacctccattggcgaaaatctaaggttccaatcttcataaatctttgggtaagtcaatcctaactcgattccttcatcatttcttcttcaatcattgaatttcctctctttaaatcatgaattcaagctagaaatttggggttagctagggcttaggggattttgggcatttcaacctcaatttgaggtcgaatttaaaaactaattatatatttgaactcgtggggatagggggattgggttttggtccgaacctcgagtttggaccacgtgggcccggtgtcggattttggaatttttggaggaaagtttaggatttcatttctaggctatgcgattgaattattgagttgttattgatgattttgaatctaattatgcttagatatcgttgtttgggagttgaattctgaagggaaggcggttgtagagctttgaattgctagttcggcatcgaggtaagtgattgttctaactctagttcgagggattaggactaggatattatttgctatgtcttacatgggtcggtgtataggtttggtgacggttacctatgcgcccgagtcaaagcatgaccgtgggtctttaattgaagttattgaaagctatgtcatgaattctagttgttgaatcagtccttataaataattgatggaatcaaatgcattaaatgacttaaatggatagttcaagtgaaatgccttgccgaatagtgttgaactctatgtgattcttgtttcccttgccgggattgtttggatatagctgcacccttgctggatatggtggatttcgacgtcattctagggatgtattggttgtctccttatcatgcgatcttggattgtcatgccaagaccatgaccttggcgttgccggatatgccccgattagagtggagagggacccccggtcataccactcgcagtgtcattttttatgtgaaagctcgacgtatggtcgataaggggtgtctagcttatctggcttatgttcgcgactccagcgctgaggtcccgtctattgatttcgttcctattgttcgagagttccctgaggtttttccttctgatttgccgggcatgccgcccgacagggacatcgatttctatattgatttggtgccgggcactcagcccatttctatccctccttatcgcatggcgccgccagagttgaaagagttaaaagaccagcttcaggatttgcttgagaagggtttcattagacccagtgtgtcgccttggggtgctccagttttatttgtgaagaagaaagatggttctatgaggatgtgtattgactaccggcaggtgaacaaggtaacgattaagaacaagtatccactgccgaggatcgatgatttatttgatcagcttcagggttcgaaggtattctccaagatagatttgagatccggttatgatcagttgaggattagggcgtctgatgtccctaagacagcatttcgtactagttatagtcactacgagttcctggtcatgtcatttgggctgactaatgccccagctgcgtttatggagttgatgaacagagtattcaggccttatttggacttatttgtgatagtcttcattgatgatattctcatatactcccgcagtcgggaggaacacgagcagcacctcagagtggttcttcagaatctgaaggatagtcagttgtatgccaagttttctaagtgcgagttttggttgagttcagtagcattcttgggtcatgttgtttcagcagagggtattcaggtagacccgaagaagatagaggcagtcaagaactggcctcgaccagcttcagctacagagtttcggagcttcttggggttagctggttattatagacggttcgtagaggggttttcatccattgcatcccctatgaccagattgacccagaagggtgccttattcaggtggtcggacgagtgtgaggcgagctttcagaagctcaagacaacattgaccacggcaccggtattggtattgcctacaggttcaggaccgtacacggtctattgtgatgcttcccgtattgggcttggtgcagttttgatgcagaatggtaaggttatagcctatgcttcaagcaagttgaagatccacgagaagaattatccagttcatgaccttgagttagcagcgattgttcatgccttaaagatttggaggcattacttatatggtgtgacgtgtgaggtttacactgatcacaagagtcttcagtatctgttcaagcagaaggagttgaatatgaggcagagaagatggttagagttgttgaaggattatgatgttactattctatatcatccggggaaggccaatgtggtggccgatgcattgagtaggaagtcagctagtatgggtagtcttgcttttatcccagttggtcaaagatcgcttgccatggatgttcaggccttggccaatcgttttgttagattggatgtttcggagcccagcagggttttggcttgtacggttgcccgctcttctctatttgagcgtattcgcgagcttcagtttcatgatccccatttatgtgtcctgagagacacggttcagcgagggggtgccaagaaagtgactttgggagatgatggggtgttgagattgcaggggcgagtttgcgtgcccaatgttgatggtattcgtgatttgatcttagcggaggcccacagttctcggtattctattcacccgggcgccgcgaagatgtattaggattgagacaacattattggtggcgtaggatgaagaaggatatagtcgcttatgtcgctcggtgtttgaactgtcagcaggttaagtatgagcatcagggacctggtggtctatttcagaggattgagcttcccgagttgaagtgggagaggatcactatggattttgttattggcctcccgatgactcgaaggtagtgtgattcagtttgggttattgtggatagggtgactaagtcagcgcacttcattccgtttgctaccacctattcgtcccagagattagctgagatttacatcagggatatagttcgtcttcatggagtgcccatatctattattttggatcgaggtccgcagtttacttcgcgtttctggacagccttgcagggagagttgggcactcgggttcagatgagtacagcatttcacccacagacggacggtcagtccgagaagacggttcagattcttgaggatatgcttcgagcctgtgtcattgactttggaggctcgtgggaccagtttttgccattagcagagtttgcctacaacaacagttaccagtccagcattcagatggccccgtatgaggcgttgtatggtaggcggtgtaggtacccagttggatggttcgagccgggagaggctcggctattgggtacagatatggttcaggaggccttggataaggtcaagatcattcaggatagactttgtacagctcagtctaggcagaagcgttatgcagaccgcaaggtcagagatgttgctttcatggttggagagcgagtattgctccgtgtgtcgcctatgaagggcgtgatgaggtttgggaagaagggcaagctcagccctaggttcatcggtccgtttgagattctggagcgagtgggagaggtggcatatagacttgctttgccacccagtttatcagctgtgcatccagtgttccatgtatccatgctccggaagtatcacggcgatccatcgcatgtattagatttcagcactgtccaattagacaaggatctgtcttattaggaagagccggtggctattctagaccggcaggttcgacagttgaggtcaaagagttttccttcggtgcgtgtttagtggagaggtcagcctcctgaggcttcgacctgggagtccgagttcgatatgtgtagccgttatccccatctgtttcccgactcaggtacttcttttttttgtccgttcgaggacgaacggttgttttagaggtggagattgtgacgacccaatggggtcatcaccgtaatgctcctttgtcccgtgcttctgaggcctcgaaaacctcttgaggggttgcctcgatttgcgtgcgcagtccgggcgcgaagccggaaagattttatgtgatgtaagttgaattctgtgttaaaaatggtgaatttcaagtataatattaatagagttgactccggtcaacattttgggcaaaagggcccggacccgtgatttatcaatttctaaatatccgtaggaaaatatgggacttgcgcatatgcccggaattgatgaattccgaggtcccaggcccaagatacggaattttctgtgaaaatagtttctgaaaataacttgagattatgaaaatgaataattgattttaaactgtcgtatcgggctcgtattttggttccgacgcccggtacaggtcttatatggcgtttaagcgcttcctgtaagatttggttgaaatccgacgtcgtttgacgtgtttcggaccctaaaagctaaattgaaagtttgaagttaaagtttggaaattatggattttatggtttaattctatgattatgatgctattttagcgatttgatcgctcgagcgagttcgtaggatgctaatgagttagtatgagtgtttggttgggagtcccgagggctcgggagtattttcgggggtggttcgggaagtttttggtctttttgtgttgcagattttctccaatttctacccagtggtgcccttctatgcgatcgcatggtggtggctgcgatcgcatagagtctcctgtcagccccttcatttttgctctctgcgatcgcagagatagccttgcgatcgcgttcctttagcccgttgttatatgcgatcgcatcaattctattgcgatcgcgtagtgtaattcatgccccaggccagcccacccttttactcaatgcgatcgcagtttggtccctgcgatcgcgtaagcttgaatcccagcactctatgcgatcgcatcatgtgctccgcgatcgcatagagtgatttttgcccagcgattttaagttacagaatactattttggccgagacccttcttccatttttcactcaaactcatttctaaaacctccattggcgaaaatctaaggttccaatcttcataaatctttgggtaagtcaatcctaactctattccttcatcatttcttcttcaatcattgaatttcctctctttaaatcatgaattcaagctagaaatttgggtttttgaggttagctagggcttaggggattttgggcatttcaacctcaatttgaggtcgaatttaaaaactaattatatatttgaactcgtggggatatgggggattgggttttggtccgaacctcgagtttggaccacgtgggcccggtgtcggattttggaatttttggaggaaagtttgggatttcatatttaggctatgggattgaattattgagttgttattgatgattttgaatctaattatgcttatatatcgttgtttgggagttggattctaaagggaaggcggttgtagagctttgacttgctagttcgacatcgaggtaagtgtttgttctaactctagttcgagggattaggactaggatattatttgctatgtcttacatgggtcggtgtataggtttggtgacggttacctatgcacccgagtcaaagcatgaccgtgggtctttaattgaagttgttgaaagctatgtcatgaattctagttgttgaatcggtccttataaataattgatggaatcaaatgcattaaatgacttaaatggacagttcaagtgaaatgccttgccgaatagtgttgaactctatgtgattcttgtgtcccttgccgggattgtttggatatagctgcacccttgccgggttagatgaatttatgtgaattgttgtgttccttgggatatgacttatgtgtaattgaatagagctggacttctattgatgttgggatcgtgtggcacgccgtccacttgaaagtattgaatatgggatcgtgtggcacgccgtccactggaatatattgaacatgggatcgtgtggcacgccgtccacctgtgaattatgaaatgggatcgtgtggcgtgccatccacttttgaatactgagtatgggatcgtgtggcgcgccgtccacttcgtactttctgttttactcatggtactcgtagattaaatgcttaaacttgctttccttatgctttagaactgtccccccttacagcatgtcccctcccgtacttgtttactttgtatattacttttctgttttcgtatgcatatatatcttgcacaggttaacgctgtaggtcctgtctagactcgtcactacctcgtgagccggggttaggccagacacttaccagcacatagggtcggattgtgctgatactacacttctgtgcccttttgtgcacagatccgggagcagcttttggagcgcatcagcagtagacggggagccaaccttcagtccagagacggcgaggtagttcactggcgtccgtggaccatccagtctcttccattaaattcagtttgtttatcagttcagacagacagtattgtatatttttatttcaaacgattgtatgtagtgactcttagaagtccgtgtgctgtgacactggttcttgggtagaggattgtgttagattcttccgcattttgcagttatgaaagtaattaagtctttcgcttattttctcttattaattattaaatgttgaatattaatgttgaatgtgtattagttcggcttgcctagcttcgacagtaggcgccatcacgatacccgttggtgggaaaaatccaggtcgtgataattcttacctctcacgaccccagaataccacaacttaaacctgtctgcattcctcgcctttgtccctttccacctagtctcttggacacaggctatgttgaccctcctcttctgaagaaccttcgccaactcaatggacttacccttcagagtgcctacgttccacgatccgatccttaatctatgagcgcccgctaccctcttcccacccttgcctcccgctctacccgcagaaccgctcccagcccccctgctcacccctgcccccacccccgccccccgaggacatgaccttacactaccatcccccgtaagcaacatcatggtggaaaaatctttgagcttgtaagttgttctaatatgtttcaaaaactttttcattaggtaaaatatatttcatcaaaatatatttatacatattatttcattaaagttaatcaatagttataaattaagtgtgaatgttaaaatcgaactctttaaatttacaacccatctacaatataaataaaaaaagaagtaccaaacattattactgaactaatttgggtgtgggaataatattaattattaataatacaatatattttggggccgacaaagttgcacaatttatgaatatggaggaggtattagactcgtgatgtctactccatctacgaacatattttacctctaccaatttctctccacatgggttctggtaaataaaaggaaactaaccctaaatacattgcaaaaaactaacataatatttgaggaaacaacataccaaatagtcatggtctcgaaagtggctcgtgcgcacactagaataacgcaaacaaccgctggcataatagtctccaaagcatatctatcacattatttcatggagaaactgaacaacagaacacagaatggataaaataaatcgaagtctgtagcaatcggtctcaaaagcataagcatgaaaaaactggagaccgatgcagtaagaataacccaatacaacaaaggattagccaaatcaccttttctatggtccaaataactccaagcatcccgagcggccctacaatgttgcagaacttcacatattttggtttgatcaaaccagacccattaaacacacgagccttcaaacattcggaagttaccaccatgatacagaaatccccaagcatgaccaatcccgcagtgacgctgagccaattgatgccttgatccactgtttggccatcaaatatcaggagccctgcacatcccaaataggagaatacaaatagtagaaaccacaaaacttattcccaatccctcatcgcacccacctgcaccatttttacacacacatcacactagcactttactaaaatctagcacaaaataaacgcaaccaaaatatattccacggtagagtaaatccccaaatcaacctattcagtaagtattaaacaataccatttttcaacaccatcttagtactactactattatactacataaatctcaaacatttatattgaagaaaatattattaacaaaagtttatattacattgacagtgaatataagtcagctccaacactgtaatctatcataataaccgatttctattgctggagaacatgttaaaaagatttcttcccgtaaagttaacaaatgcaaagaaaataacacaaaaaaataaatacaaaaggacaattggaaacaaaagttgaaagatgatctcatgtgtatctccgcattttctacttctataaacaaataccacaaaacgaagaaactaagcaaacagtaaataagaaactcattgcaaccagagggggacccaggatttgagcacgacgaggcacaactgtgtgctaatcactagcgataaaattcggcatgcaactctttgaaaacttaatgattataatgacttatcatccacgtataaacaaaaaaaagttctaaagaaaagtaagtaacgaacaaagagagattgctttgcaaaatgggggctctgggaagagaaaatgtttgattaagcatgtttcgcactttaaaatttctaatttattttttaaataaaagaaagggtcaatgatcgaaagagagttcaaactttaaagaaatcaaaattaaggatatgttgatagtaaaaaaaaaacaaaaaagagtcttaaactcttagtctccactgccgagtcagagtcaaaataattgatgaagaaggttgtggtgtacggatttgtatttttctatttgtggaatgagaagttgcaatttgaagattttaattttaagggatgaattaatttttttttaattaagttgactattatgtattagaaattagaattaaactataattgaattcaaaagaaataaaataaagaaaaaaaaaatatttaacaatttgttaggaagtatgaaagtacgttgtattcaattaactaaaaatatgggatttttttcctaactataccatatatgaaaccttattaccctaaatgtgcatagtttgttaattacccgcccagtccacactttaactacaatttatataccattcgactattaggcattaaaagggcagaatattccctaaaaaacgcgctaaaattaatgaaagaatcttggtgttaattgattctacattaaatttaatttttaaaaagggaaaggagatttctcacgtgaatttgtgcaattatttactgcctctgctctttgctctttaattatcctccaatattacttcatcagttacgtcaatcttcgaactgattaatatttctcaaattattcctttttcttttgagtttagaaggcaatgaaacgaagaattaattaggaaatcaaatttactttttttctatatgacatcttgtttaaaatgataataattctatttccatttgttcaagttagataaatattcatatttgttcaatcagcaatgtctttttatattaatttaagtttgatgtacctaaactgcagtctatgttgaaacaaaatgttgactacaaaattttctcttaatctacaaattttctataaaaaatctacaaataaactacaaatcagtttatgtatgtataaatgtgacgacccgacccgtcgtctcatgtgtttccgtcccgttttccccgttttatgcttgtacatgtttcattatatgtgtttggtgagtttgaagtaattcggattgagtttggtaagaaatgagacaagtagtctctttaaggaaaggctagtttgaaaaagtcaaccggaagtggacttgtgagttagagggctcggaattgaatttcgatgattcggttagtttcggaggatgatttaaggcttaggggcacaatcaaaataaattttggaggtccggtgaagaaattagcttattttggcgaagttagtattttggcaaattccggttgataggtgaaattttgatctgggagtcggaatggaatttcgacagttccagtagctttgttatgtcattttggacttgtgtgcaaaatttgatgtcaatcggacgtgatttgataggtttcggcatcggaaatagaagttggaagttttaaagttcataaagcttggattggaagtggattcatgattttagcattgtttgatatgaattgaggcctcgagcaagtccataatgtattttgggactggttggtgtgattggtcggggtcccgagggcctcgggagtttttcgggttgtgatcacgctctcatttgatgttccaacgacgtatctttgggcataaaggggtacaatattaagaaaatgagctccaaattcagttttgtttgaaccactagatcgtatcaaaattacggagccacaggaaaaataatcgtcgaatatcgagtttgtatgagggagttatgctcatttccgtgtcgggagaatctggttgctgtcaaaaccttataagcggaaattgaccgcggatgctggaccgcaaaagcggaaatagaaccgcaaaagcggtcccgcatatgtgaaaaatgtccgcataagcggaaagggccgcataagcggaaaatggaccgcataagcggaaaatgggcctgggcggagactttaagtcccgaaaatggccatttctccaccattttaagtccattttgagagcttttggacggggattgaagggagtttcaactaagattgattggaagtaagttttatgagttaaatatatgattttattgaagaatcatcctagaaatccatgaaaacatagcaaaatcatatgaaattagggcttgagattaaaattataaaatggtgatttgaggggtcatatgaactccgattttggtaaattttatatgtacagacttgtagcgagataaggaacattttgatgtaaaaatttttggatttaaagatgtaggcccagggctcgggttttgtaaatttcgtgaatttcgatatttttctagtcatttcgattgggttatgtttccttagcaaaatgtaatgtattcatggtggttttggctagattcgacgcgcgagaaggtcgattcaagaggaaagggcattgcggactagtctacggccggttagaggtgagtagtttgtatagatgataacctgagggtttgaaaccccggtatatcacactgtgacgctatattgaggcgtgactcgcaccccatggcgggtgtgggatcatatatgattggggattgtcgcttggtccatcccgattgataattataatatattggcgactgatacgtacattgtattgatgatattgggcttgttgcctcgtttggggccttgtgccgacttgtagaacccttcggggattgatgttatcgttgttagcgtacttgcatatcatttggttacaggccaaagttttaaatacttttttgcaaactcagccacgtttcctaagttttgaaaacacaaataatactttaaatgctatttcgggctgataattactgttttacaaatgcccaggggccttatatgttttctggactgtataatatgacttgaaacaggggtaacaatggaactgtatgatataaattggtcaggtaacaatgactgaccattgcgcttgggctgtaggagcccctccggagtctgtacacactcccagtgagcgcgggtatccatatggatcgggctgcatgccgcagtggttatgtgcattgcattgcatacatgcattcatacttgtctgatatatctgaggtggttgtgttgctatttcatcacaggttatattaaattgatagatctagctttacactgtggcatttcgtggattcttatactcagatattatatatgcttattactcactgagttggtagtactcaccctactccctgcatctcgtgtgcagttgcaggtattgcttcccggaagcgggttattagcagattgaaggtactatcgtagctgagaaaggtgaccgccagcgttggcggcaccgtacttcatctttcgaactccagtttgtactttatatttattattggtccagtagtggtattcagtcttctttagatgctcgtgacttgtgacaccccagtcaggttgtattgggataaaaatcaatagtttttaatgcaattatgttgtattttctactcatttatgtttacaaatttgtcaaagaaaggttttggggtagttggctggccttatcttcacgagaggcgccatcacgaccaagtatagactttgggtcgtgacaagttggtatcagagcctaggttactaggtctcacgagtcatgagcaggtttagtagagtctcgcggatcggtacggagacgtctgtatttatcctcgagaggctacagaacctttaggaaaacttcacattcttggaattcttatcgtgcgtacttgatttagcttggaatataactcttgaaattccttccttacgtttgtatgcgcacatgagcgctcagtattatatgtgccttgatggcttataattccccgatcgaggggcgagatgtgattgctatgagttgatgttgggccaatctggaggacttgaggccgaatctccgtctatgacttgagcaccgaggtactgattttgcgagctggtattatgaacttatatgttcggtattgtccctaattgtgggaacgacggctagatagctatgtgatcagtatgttggtgttgcgtggtgtgtctatatgacttggaagtgtcgaggaaggtctactggatgatagatgaactactgagtgtatgatttctattgtaataggatgtgtagccccaagttatgggcacctgaagatcttttcatgtctcctgtttggagtgaagtaaatttcatgttacggtatgagtttagactcaggaagtgtaagtgattgtgtaatgtgtatggcagcggaaggtatacaaaaatattaactaaaggtaaagctagtgggtaattggcttatgggggaaatctatttgcatactagttagataagtctgggagctgagatcgcttctgtagatgtattatgacgaaatccttgggtcaaggagacaaccttgaaggtcgaaagcatttaaagaaagaatatgttcttacttggttgaatagcccaataatggagggttgaaaggtattttctatgtgttatgattcaaataggtgcaacgcatgtccatgtctcaattttgatagtataatacatgtagtattgagatttatgtaattgatatgcattgtgatgctttgtcaagttgtggatgtgttgttaggatgtttttggtgattctctagcaggtggatagacacaattacaagggagactctgccgaaatttttgaaaaatttgggacttagtaaaaatttggtcgccttgagagtgggcttaactattgtttgagtaaatgcaagaattggagaatagttaaaattccagatgatttgtgtttccacgagcttatgaaggagtgagtttaatctcactatggtgttacggcagcaatagaatacatgtgttgtgatttattgagcgcgttttgatctatggcctcgagacaagttggggaggttgctgtggagtagctgattgcacagatatgtgttatgtgattccgtttcggggtatgctggcggatcagttctgattgcagaaattgagccgagggtggtacgagtgaagcaaaaaatttgacaaaggctatatggtgcttcgtagatgtgagaaaataataggatgtcttgagttgttgataaggaatgcttagtgtaaagagaaggaagttgtttggttgtatctaaatgagatcatgtcctgcggtgtcagagtactgataaggcacgagtggttcgattcgttaagccaagtaatttgcagtgtgtataagagtggatgactcttgagaatggttttgatgtgttcaagattctatatgtagcactcatgtgttttaaggttgagtatgtgaccaagacagtgttttcattagaacaggtcaagacttgtagtatttttacgttaattacgggattctatgtatcagtatctgggaagtaaaggtagcggactagattcgcaggaagttcttcagagtagggtattttagaaggtggtatttttaggagcgtttgagagagtatttagtggcctattggtcttagacagtgtggtcctacgttcgagtctcatgtggtaagcctgggttgaggcattgtggtgctacaacaagagagtatatcaagttgaaaatgaatcagaaggaaatctagacaagtaaagtaacttgttagtggaccgaatcggtatggtaaagatatgatcaatcctttgtatgtgttcgaggtaatgggttcttacaagcgttgggcagcgaagctcctgagtactggcagtctgcttagcttgttggcagtttagcttgtgcaaatggaattgggagagaattcttgttgagtttcattatggtttggagatgtatattttctatggacatgcggagcatggagcgtgtaatgatttttcttctaaatgggatcaatgaaagttctggactagttgagtgcgtcgatgtctgcggcatggaagagagatgaaagttctcgtgttatccttggaaggtatggtatatgaggtatgttgtagaggaccgagacgggcgtgtgcgaggtttcagttcagttctgaaaggaagttcaattcttaggcaacgagtagcctcagataatcaaggaaatggtactattaattgaaagtgatttggcgatagcatatgtctcggaaggagggtaatgtgatcaacctaatgatacatcagtagtgttgcagcattttcttgtgggatcgactgctaatattcaagtttgctgatggcacagggaaattttataatatcttttgtggaatgaatgggttctcgatgtgtgatatgtatccatgcaggtgaatgtgggatcaggtatagtgatttgtgtgttatatggagttggagactgggagttctccgatacagtctatgtcgtggttgtggatcgtgtgtattcggcactgttaagcggaaattaggatttagaggctagagtggatctttatttgctgatatgttagatttttggatgtgatgttgaaatccagactggttgtctcagtgttgggttattctagactattgtgctatgggctatgttgtaaaatgccacaggttgcgtggcgaggtgcatcagagtatgttatagcagagtggttgtattccaaagatcagcagacggctgggaaggattgcttttcttaatttggccttcgtggcggatgtcagtgtagaggtttctaccatggattcagtttcggtaacgagggaccttttcggatgcgtttcttatggccgggcatgttgccaggtgagattgtggatttcagtatctatttggtgtcgggtatcgtattgtacgactccggcatgagttatggtagtggaagaagcagcgtcaggcttcttggtattgagtttgttggtaagctgattggatacgtgtttagcttgagttggcttggttagtccctaatcgtattgatgaaggatacattgagtcgattgttattgaacctgctagtgatctgggagatctatgagttgcttttctatgctgtgaggcgttatggtttgttggttatgggcacatgtggtgcagttctattaaggattcagaaaggaagtcgagcgggaagagtaattgagtgtttctcggtgtataaagcattggtcatggcctatcgggtggcgtgtcgtatgatatttgtttcaccacgggtgtaatgaattgttttggcttcagtcatcaattgtgtgtggctggacatttggatcatagtgacttgaggtgcttcatgtgtaacagtgttggatagaatcatacattgtagcgaggctacgtggagttatgacctttcgatgcggatttaggtactctatttctatgatgtgagacggggtctcaacttcgtgttgtaatagtattgatgagcttgaggtacaactctttcgtttgagtcattttcatgatttgagtatgttcagaccgtctcttattggtgcgggtattatgcaagttgtggcttaggccggtgttgaggtgtcatatcaccaaagtggtgtactggacccaaagtgattgttgggggtcattaatgaatacgaacggatttggcttcagcttgtggtaaggttaatatcgaggttcggctcgggaattgttgtggtagtagtaaagggggaaatgacttcataaatggtttatctgagaaatggttatattttatcgcgtgttttatttatagttggtagtatatgaaagtgttggaataagaccttagctaacaagaggctttctatcggtatttgggtattgtgggcaactgctgtgaatagagactatcatttagagttttggattatgggttattacagctggttcgtgttaattctaggtatgatttcggaaagtgcaatgtggttctacggtttatggtctaaatggattgcgaaatttcaactgtgttgtatcatcggacctatgtgaaatagggtgacgtgggatcaccttgggtatatgcttggtaagatcattcagctattggttggcttctagaacaaccctagatacgctcgaggacgagcgtttatttaagttggggaggatgtgacgaccagacccatcttctcatgtgtttccgtcccgttttccccgttttatgcttctacatgtttcattatatgtgtttggtgagtttgaagtaattcagattgagtttggtaaaaaatgagacaagtagtctctttaaggaaaggctagtttggaaaagtcaactggaagtggacttgtgagttacagggctcggaattgaattccgatgattcggttagtttcgggggatgatttaaggcttaggggcgcaatcggaatgaattttagaggtccggtaaagaaattagcttattttggcgaagttagtaggttgataggtgaaattttgattcgagagtcggaatggaattctgacagttccagtagcttcgttatgtcattttggacttgtgtgcaaaatttgaagtcaatcggacttgatttgataggtttcggcatcggaaatagaagttggaagttccaaagttcataaagcttggattggaggttgattcatgattttagcgttgtttgatgtgtattgaggcctcgagcaagtccataatgtattttgggactggttgctgtgattggtcggggtcccgagggcctcgggagtgtttctgtgacgacccaaaggggtcatcaccgtaattctcccttgttccgtgcttttgaggcctcgaaaacctcttgaggggttgactcaatttgcttgcgcagtccgggcgcgaagccggaaagtttttataatgtgaatgtggaattatgtgtctaaaatgagaaactttaagtataatattgatagggttgacttcggtcaacattttaggcaaacgggctcggacctgtgtccgtcaatttctgaaaatccgtagtaaaatatgggacatgggcgtatgctcggaatcgaattccgaggtcccaggcccaggttatgaatttttctgtgaaattgattttcgaaattaatttaagataataaaaaagaaaattaattaaaaagctgtagtatcgggctcgtattttggtttcgacgcccggtacaggtcttatatgttgtttaagcgctatctgtagagttatttcgaaatcggacgtcgtttggcgtgtttcgaaccttaaaagctaatttggaagtttgaagtgtaaaatgggaaaatatgaattttcatggttcaatccaatgttttgatgttattttggcgatttgatcgctcgagtaagttcgtaggatgttaatgagttagtgtgtgtgtttggttgggagccccgagggctcgggagtgttttcaagtaatttgagatttcgtcgtgccaaggtagattaactattttatttcgtgtacaaatgaggatttaggatattatgaatatcaattggatatgttaataagtgcataagttgtattagaggtgaattggggtctaaggacaagcctaagtctaagccaagttggaaaatttcagattagacaaaatctgtgaatgagtgaggcaggggtagaggtcatagaggtgaaggcagatgtcttagaggtggagctcagccagctagaggtaggggtcagacagcagcagatcatcctagggatgccattcagggaggtggggcccagccccgttgttatgctttgccagccaggccagaggctgagtcgtccgatgcagtgattacaggtactattctggtttgtgatagagatgttttagtattatttgatcctggatccacgtattcctatgtgtcgtcatattttgcaccctatttggttatgcctagtgaggctttgggtattcctgttcatgtatctactccagtgggggattctatagtagtggatcgggttcatcgctcgtgtgttgtggtgttcaggggtcttgagacccgtgtcgacttgttattgttggatatggtggatttcgacgtcattctagggatggattggttgtctccttgtcatgcgatcctggattgtcatgccaagatcgtgaccttggcgttgccggatatgccccgattagagtggagagggaccccatgtcataccactcgcagcgttatttcttatgtgaaggctcgacgcatggtcgagaaggggtgtctagcttatctggcttatgttcgcgactccagcgctgaggtcccgtctattgattccgttcctattgttcgggagttcccagaggttttcccttctgatttgccgggcatgccgcccgacagggacatcaatttctgtattgatttggcgccgggcactcagcccatttctatcccgccttatcgcatggcgccgccagagttgaaaaagttaaaagatcagcttcaggatttgcttgagaatggtttcattagacccagtgtttcgccttggggtgctccagttctatttgtgaagaagaaggatggttctatgagaatgtgcattgattaccggcagttaaacaaggtaacgattaagaacaagtatccactaccgaggatcgacgatttatttgatcagcttcagggttcgaaggtattttcaaagatagatttgagatctggttatcatcagctgaggattagggcgtctgatgtccctaagacatcatttcgtactcggtatgggcactacgagtttttggtcatgtcgtttggactgactaacgccccagcagcattcatggagttgatgaatagagtattcaggccgtatctggatttgtttgtgattgtctttattgacgacattcttatatactcccgcagtcaggaggagcatgagcagcacctcagagtggttcttcagactctgaaggatagtcagttgtatgctaagttctcgaagtgcgagttttggttgggttcggtcgcattcttgggtcatgtcgtgtcagcagcaaatattcaggtggaccgaagaagatagaggcagtcaagaactggcctcgaccagcttcagctacagagaatcggagcttcttggggttagctggttattacagacggttcgtagaggggttttcatccatagcatctcctatgaccagattgacccagaagggtgccttattcaggtggtcgaacgagtgtgaggcgagctttcagaagcgtaagacatcattgaccacggtaccggtattagtgttgcctacaggttcaggaccatacacggtctattgtgatgcatcccgtatcgggcttggtgcagtattgatgcaggatggcaaagttatagcctatgcttcgaggcagttgaagatccacgagaagaattatccagttcatgaccttgagttagcagcgattgttcatgccttaaagatttggaggcattacttatatggtgtgacgtgtgaggtttacaccgatcacaagagtcttcagtatctattcaagcagaaagagttaaatatgaggcagagaagatggttagagttgttgaaagattatgatgttactattctataccacccgggaaaggccaatgtggtggcagatgcgttgagtagaaagtctgctagcatgggtagtcttgctttcgttccagttggtcagagatcgcttgccttggatgttcaggctttggccaatcgtttggttagattggatatttctgagcccaactgagttttggcttgtatggttgcccgctcttctctatttgagcgtattcgtgagcttcagtttcatgatccccatttatgtgtcctgagagacacggttcagcgaggaggtgccaagaaagtgactttggggagtgatggtgtgttgagattgcaggggcgagtttgtttgcccaatgtcgatggtattcgagagttgatcttagcggaggcccacagttctcggtattctattcacccgggcaccgcgaagatgtatcaggatctgaaatagcattattggtggcgtagaatgaagaaggatatagtagcttatgtcgctcggtgtttgaattatcagcaggttaagtatgagcatcagagacccggtggtctattttagaggattgagcttcccgagtggaagtgggagaggattaccatggattttgtcactggtcttccgatgactcggaggtagtgtgattcagtttgggttgttgtggataggctgaccaagtcagcgcacttcattccagttgctaccacttattcgtcccagagattagctgagatttacatcagggagatcgttcgtcttcatggggtgcccatatctatcatttcggatcgaggtccacagtttacttcgcgtttctagaaagctttgcagggagagttgggcactcaggttcagatgagcacaacatttcatccccagacggatggtcagtccgagaggacagttcagattcttgaggatatgcttcgagcctgcgtcattgactttggaggctcgtgggaccagtttttaccattagcagagtttgcctacaacaacagttaccagtccagcattcagatggctccgtatgaggcgttgtatggtaggcggtgtaggtccccagttggatggtttgagccgggagaggctcggttattgggtacggatatggttcaggaggccttggataaggtccggattattcaggatagactccgtacagctcagtctaggcagaagtgttatgcagaccgcaaggtcagagatgttgttttcatggttggtgagcgagtattgctccgtgtgtcgcctatgaagggcgtgatgaggcttgggaagaagggcaagctcagccctaggttcatcggttcgttcgagattctggagcgagtgggagaggtggcctatagacttgctttgccgcccagtttatcagctgtgcatccagtgttccatgtgtctatgctccgaaagtatcacgatgatccatcgcatgtgttagatttcagcactgtccagttggacaaggatctgacatatgaggaggagccggtggctattctagaccggcaagttcgacagttgaggtcaaagatttttcctttggtgcgtgttcagtggagaggtcagcctcctgaggttctacggtttatggtctaaatggattgcgaaatttcaactgtgttgtatcatcggacctatgtgaaatagggtgacgtgggatcacctagggtatatgcttggtaagatcattcagctattggttggcttctagaacaaccctagatatgctcgaggacgagcgtttgtttaagttaggaggatgtgacgacccgacccgtcttctcatgtgttttcgtcccgttttccccattttatgcttctacatgtttcattatatgtgtttggtgattttgaagtaattcagattgagtttggtaaaaaatgagacaagtagtctctttaaggaaaggctagtttggaaaagtcaactggaagtggacttgtgagttagagggctcggaattgaattccgatgattcagttagtttcgggggatgatttaaggcttaggggcgcaatcggaatgaattttggaggtccggtgaagaaattagcttattttggcgaagttagtaggttgataggtgaaattttgatccgagagtcggaatggaattctgacagttccagtagcttcgttatgtcattttggacttgtatgcaaaatttgaagtcaatcggacttgatttgataggtttcggcatcagaaatagaagttggaagttctaaagttcataaagcttggattggaggttgattcttgattttagcgttgtttgatgtgtattgaggcctcgagcaagtccataatgtattttgggactggttggagtgattggtcggggtcccgagggcctcgggagtgtttatgtgacgacccaaaagggtcatcaccataattctcccttgttccgtgcttctgaggcctcgaaaacctcttgaggggttgcctcgatttgcatgcgcagtccgggcgcgaaaccggaaagtttttataatgtgaaagtggaattatgtgtctaaaatgagaacctttaagtataatattgatagggttgacttcggtcaatattttgggcaaacgggcccggacccgtggtccgtcaatttttgaaaatccgtagtaaaatatgggacctgggcttatgcccggaatcaaattccgaggtcccaggcccaggttatgaatttttcagtgaaattgatttctgaaattaatttaagataatgaaaatgaaaattgattaaaaagttgtagtatcgggctcgtattttggttccgacgcccggtacaggtcttatatgttgtttaagcgctatctgtagagttatttcgaaatcggacgtcgtttggcgtgtttcgaaccttaaaagctaatttggaagtttgaagtctaaaatggaaaaatatggattttcatggatcaatccgttgttttgatgttattttggcgatttgatcgctcgagtaagttcgtaggatgttaatgagttagtgtgtgtatttggttgggagccccgagggcttgagagtgttttcgggggtggttcgggatgttttgaagttgaaaaacacatcagatttcttaaagtgttgcagacaggtatttaccctatgcgaacgcaatcctcatccgcgttcgcatacgcctgccttcgttacccccttcgcattcgcagtcccctatcgcgttcgcatagtgcaatttttcaagcccagtaaatttattcaatgcgaacgcattgttactccgcgttcgcatagctgtagaaagggaccctaggattttcctctacgcgttcgcatacccacctcgcgatcgcatagtacagaccatgccccccccacttttcttctatgcgttcgcatagatgctccgcgaacgcatagtgtttcctgccagttattcaatgcgaacgcatcaccctattgcgatcgcatagagttattttgcccagtgattttaaataattccagaacagtgtgcagggggagtattcataattttcactcgaacttcttcgtctccaaggctcccaagcgtccattgaagccccatttcacctagacttcttgggttagtaaattcctactcatttcttccattttcgatcaataatctctgaaatcctaactttaagtcatgaatttaagctagaaattaagggtttggaggttagctagggcttatgggattttgggcatttcaacctcatttttgaggtcgaatttaaaatctaatcatatatttgaactcgtgggaatatgggggattgggttttggtccgtgtcacgacccaaaatcccggatcgcgatggcgcccggccgtaaggctaggcaagcccgaccacagcaacccaacaatggcatttcagcccaacaagaaacaagtgctagatttaaatcacagtttaaatatcaaaccgcccagtcagggccatgacaatatgaaaatagactgaagagttcaacaacattcccaagaacaagggtcacgagtaccgagcctctaaatggtatcaacaatatgactggaagaacatacaaagtctgaaactagaaggaaatgataaggatcggagaatgggtcctgcggacgccggcaactacctcaagtctccgtctaactgatgaaacagcagcgacatcaaggctatggctcagcaacacctgaatctgcacacaaggtgcagggagtatggggtgagtctaccaactcagtgaggaataaatgtatataaaaacccgaaagcaggaaaacgcagtaaagcacaaggtaaagctatctacacagtttcagtcagaacatttccaaatatatccagataagcaacagagaatataagtatgaatgctatgcaatgcaatgcacatgtccgctacggtgcgtgtagcccgatccctttgggtacccgcgctcactgggggtgtgtacagactccggaggggctcctacagcccaagtgccatatcataataatactgctacggtatgtgcagcccgatccatttcataataataccgctacggtacgtgcagcctgatccatgtcagtccaagctatgcatgagaatcactaaaccagtccttttatagatttttaattccatttataatgaaagccatgttcaagtcatataactttagaaatagtgatctatgtaatttaaacacagtgaatagatttaggactgagattcaattaataaacaattcatgttagaacggtcatatcaatccctgaaggattcctcaagtcggcacatggccccaaacgtggcatcaagcccagatatcatcaatatagaaagcgaagcaatcgctaacacagtataatttatccctcggatcggaaccgagtcacatttcataacacatatgactccgcactaccctggagtgcgtgtctagctcacaatagcgtcacaatgtgataaaccggggtttcgaaccctcagataattatctacacccattactcacctcaagccgaccggaaaactagcccgaaatgccttttcccttcaaattcacctctctgagcgacgaatctggtcaaaaccacaacgaatacattacataatgccaatggaacataacccaatcgaaagaactcgaaaaacaacccaaatcacgaaaatagcaaaacccgagccccgggcccacgcctcgaaatccagaaaactttacaccaaaacgaccctcgtctcaccacgagtctatacatataaaattcatcaaaatcggggtccaattgctcctccaaatcctcaatttacattacaaaactcaagccctagttcttcaatattttgcccaattttcagagaattaatgggtgattcttcaataaaatgatgtttcaaggtcaagagacttacctccaatcaatcccaggtgaaaccctcttcgattcttgtcaaaagctctcaaggttgctcaaaaatggtggaaataagctaaggctcgcggatgaaataataacttaaaacattctgcccagacgtcctaactcaatgcgttcgcactcctacagtgcgttcgcatagaacaaaatctcccaggcctcccttccttctatgcgttcacatacactctatgcattcgcatagagtaaacttgaccaggcctccagctcctctatgcgttcgcacatggacagtgcgttcgcatagaacaccagtccactgccctgccttccttcaacgcgaacgcattgcactttcgcgttcgcatagtgcaaactgaccacccccaagaatacttctatgcgatcgcataagggccctgcgatcgcatagagatattttctctccaacagctgactgcatttctgcagcacttcaacaaccaaaatcaatccgacaaccatcggaaatcaccccgagaccctcgggacctcaactaaaagcaccaacttaacctaatacttcattcaaacttgttcggaccttaagaacgctaacttaaacatcaaaatcaccaaaaatccacaaattcaactctaagacaagcatgaacttaacaaaaccatatccggcgccgaaactaaccaaacgacgtccaaatgatctgaaaatttgcaggcatatccaaaatcccctaacgaagctaatgcaacttccgaaattccattccgaccctcggatcaaattctcacctatcacccagattcttccgaatttccaacttcgccaaacctagctaactttcactccggaactccggattcacttccgtttttactactaagtcacaaatcaacccctgaaactagtcgagccatcgaaaatccgttccgagccctctaacccataagtcaacgtcgggttgacctttccaactcaagcttctcttaaagagactctttaacccattcctatccaactccaatccaaaccattcccaactcaccgaatacacctaacaacatacggggaaacatatgacggggataacgggctgaaatataagaaatgacgggtcgggtcattacatcctccccaacaaaaacaaacgctcgtcctcgagcgggtcaagaaacatacctgaagcagtaaacaattgagggtatttgctccgcatctcctgctcgatctcccaagtagcctcctccacgggacgacctctccactgaacctttaccgaagctatatccttagacctcaacttgcgaacctgacgacccaaaatggctaccggctccacatcataagtcaaatcatcatctagctgaatcgaaccaaagtctaaaacatgggacgtatcctcaacatacttccggagcatagaaacatgaaacaccagatgaacttccgacaacctgggcggcaaagcaagctgataggccacctccccaaccttaccaaaaatctcaaaaggacctataaatcgaggactcaactttcctttcttcccaaacctcataacgcctttcataggcgatacctttagcaagaccttctcaccaacaatgaaagataaatctcgaactctccgatctacataactcttctgacgcgactgagctgtacgaagccgctcctgaatcaccttcactttctctaaagtatcctgaaccacatctgtacccaataatctagcctcgctgggctcgaaccaaccgaccggagatctacaccgtctcccatataaagcctcatatggcgccatctgaatactagactggtagctgttgttgtaagcaaactctgcgaggggtaggaaatcctcccaagaaccaccgaagtcaatcacacaagcacgcaacatatcctccaaaatctgaatggtacgcttggactgcccgtccgtttgaggataaaatgctgaactcaaatgcacctgagtccccatctctcgatgaaaagccctccaaaactgagaaatgagctggggacctctgtccgatataatagaaaccggaacaccatgcaatcggacaatctcacgaataaagatctctgccagccgctgcgaagaatacgaggtacatactggaatgaaatgcgtggacttggtcagtcgatccacaatcacccatatagaatcaaacttcctcgctgtccgagggagaccagtcacaaaatccatcgtgatcctttcccatttccactcgggaataaccatctgctgaagcaaaccaccgggtctctgatgctcggacttcacctgctgataattgagacaccgagctacataacccacaatatcctttttcattcttctccaccaatagagctgcctcaaatcctgatacatcttggcgacacccggatgaatggagtatcgcgagttgtgagcctctgccaatatcatctctcaaatcccatctacattgggcacacaaatacgaccctgcatcatcagaacaccatcactatcaatagtcacatccctggcatcgtcgtgctggacccgatctctaagaacaagcaaatgccggtcgttatactgatgctctcgaatactgtcatacaaggaagactgagaaaccacgctagccaacacccggctaggctcctaaatatccaaccgaaccatccgattagctaaatcctgaacatcgactgcaaggggtctctccccaactagaatgaacgccaaactgcccatgctaaccgccttccgactcaaggcatcggccactacattggcctttcccgggtgatacagtctggtaatatcatagtctttgagcaactcaagccacctccgctgcctcaaattcagatctttctgcttaaacaagtgctgaaggctgcgatgatccgtatacacctcacaagatacaccatagagatagtgcctccaaatcttcaaagcatgcacaatagctgccaactctaagtcatgaacaggatagttcttctcatgtggcttcaactgccgagaagcatatgcaatcactctaccctcctacatcagaacacatccaataccaattctcgaagcatcacaatacactgtataagaacctgaagctgctagcaatactaacactggagccgtagtcaatgctgacttgagtttctgaaagctctcttcacactcatcagaccaaacaaatggagcattcttctgcgtcaatttagtcaatggcgacgcaatagatgagaaaccctcaacgaacctgcgataatatcctgccaagccaaggaaactctgaatctctatggccgaagacggtctaggccaactctgcaccgcttccaccttctttggatctaccataataccatcactggacactacatgtcctaagaatgccaccgaaccaagccagaactcacacttggagaacttagcataaagcttctcctctctcagcctctacaatacaactctcaaatgttgtgcgtgctcctcctggctacgagagtacaccaggatgtcatcaataaacacaatcacaaatgaatccaaatacggctgaaacacactattcatcaagtgcatgaatgcagatggggcattagtcagcccaaacgacataaccaaaaactcataatgcccatatctcgtcctgaaagctgtcttcataatatcagaatcccgaatcttcagctgatgatagccagaacgaagatcaatcttagagaaaaccttagctccctgaagctggtcaaataaatcctcaatacggggcaatggatacttgttcttcacggtcactttattcaactgcctataatcaatgcacattctcattgtgccatccttcttcttcacaaataacaccggtgcaccccacggtgatacactaggacgaataaaccccttttctaggagttcctgaagctgatctttcaatttcttaagctttgcaggtgccatgcgatacggtggaatagaaatgggctgagtgcccggcaccaagtcaatcccaaaaccaatgtccctgtccggcggcatgcccggcaggtctgctggaaatacatcagggaaatacctcacaacggggactgaatcaagactaggagtctcagctccaacatctctaacaaaagccaagtacgacaaacaacctttccctaccatccgctgggcctttaggaaagaaatcaccatgctgggtacataatcagtcacaccccgccactcaactctggaaacaccaggaacagccaacgtaactgtcttagcatgacagtccaaaagagcatgatacggagacagccagtccatacccaaaatcacatcgaaatccaccatgcctaatagcaacaagtcaacacgggtctccagacccccaaacataatcacacaggatcgagatacacatgatccacaatgatagtatcacccaccggggtagatacatgcacaggtgaaacaagacaatcacgtaccacacccagatgatgggcaaaatagcatgacacataagaataggtggatcccggatcaaataaaacagaggcatctctgtgacagactggaataatacctgtgataacagcatcagatgcgacggcgtcggccctatctggtatagcatagaatctggcctgaccactgccagtacgacctccacctctgggtcggcctctagctgcctgaccacctcccctagctggctgagggggagcagaagaaactggtgctgaagatgagggctggtccctctgatgagaataagatctaccaccacggagtcgaggacagaacttccttatgtggccaaactcaccacactcaaaacaactgcctagagctggagaaggggactaaagggaacccctcgcaccagaatgacccgccgatccactcggcgctgaagaaccctaagctgaaggagcataggatgaaccctgtgcagagagtgtactcagtgaagactgaccctgctgtgaaccctgatgaccacggcctgaagacgccccgcggtactcgggacgggccggctgctgctgcctgaaagagcgacctctgccctgctggaactggcccctagacggagcactgctgaaactaccagacccacgagacctcttggcctctctctcctctctctccagacggcgatctgcctcaatgtccctagcaatgtcaacaacatcctcaaaggaatgggtcagaaccctctctctggacatcaaaatacgaacaggatagataagcctgtccacaaatttcctgatcctctcccgatcagtcgggaccatccatggagcatggcgagccaactcagaaaatctcatctcatactgtgacactatcatatcaccctaccgaagatactcaaactacctacgcagctcctctcgctgcgactgcggcacccacttctccaggaagagagtggagaactctagccaggataacggtactgctcctgccggcctacgccgctcatatgcctcccaccatgtaaatgctgcacccgtaaactgaaaggtagtgaatgatactctgctagtctctaaaatccctgcagtctggagcatgcgtcgactcttgtcgagaaatccttgggcatcgtcgccctgcgccccactgaaagccggaggcgaaagtctgctgtacctctcgagatgacgctgctcgtcctctggcatagccggaaccataacctcctgaaccggagcaacctgtggaactggcgcaactggggcaaccggtgctgctggagcaactggagcaataggggctgcctaaggggtctgcaagccctgaacaatctgctctggagtgtgagctgcaggggtctgatgtcctccccctgtctgagatgtggctgctgctgtagaagctgatactacctgagctaggccggtgcaaaccgatagaatctgggccagggcctcctgaagacccggaatcacaatgggcacaaccggtacttgagcaggtgctgctggagtctcaacagttggtgtctgatcctgaacctgggcaactggtggatcaataggtgctgcctctgtggctctgcctctaccgcgtctacggcctcgtccacggcctctagcaggtggtactggtggtcgtccggcaccttgggaagcgcgtgtcctcgccatcttcgagagaatagaatagaagactttagttctcggatcaacaaaatcgcatgataagaatttcaagaatatgaagtatttcctaaaggttctgcagcctctcgaaggtctgatgcagacgtctacgcaccgatcttcgagactctactaaaccggctcataactcgtaaggcctagtaacctaggctctgatactaagttgtcacgacccaaaatcccggatcgcgatggcgcccggccgcaaggctaggcaagtccgaccacaacaacccaacaatggcatttcagtccaacaagaaacaagtgctagatttaaatcacagtttaaatatcaaaccacccagtcagggccaagacaatatgaaaatagactgaagagttcaacagcattcccaagaacaagtgtcacgagtaccgagcctctaaatggtatcaacaatatgactggaagaacatacaaagtctgaaactagaaggaaatgataaggatcggagaatgggtcctgcggacgccggcagctacctcaagtctccgtctaatggatgaaatggcagcgacagcaaggctatggctcagcaacacctgaatctgcacacaaggtgcagggagtatggggtgagtctgccaactcagtgaggaataaatgtatataaaaacccgaaagcaggaaaacgcagtaaagcacaaggtaaatctatctacacagtttcagtcagaacagttccaaatatatccagataagcaacagagaatataagtatgaatgttattcaatgcaatgcacatgtccgctacggcacgtgtagcccgatccctttgggtacccgcgctcactgggggtgtgtacagactccggaagggctcctacagcccaagcgccatatcataataatactgatacggtacgtgcagcccgatccatttcataataataccgctacggtacgtgcaacccgatccatgtcagtccaagctatgcatgagaatcactaaaccagtccttttatagatttttaattttatttataatgaaagccatgttcaagtcatataactttagaaatagtgatctatgcaatttaaacacagtgaatagattcaggactgagattcaattaataaacaattcatgttagaacggtcatatcaatccccgaaggattcctcaagtcagcacatggccccaaacgtggcatcaagcccaaatatcatgaatatagaaagcgaagcaatcgctaacacagtataatttatccctcggattggaaccgagtcacatttcataacacatacgactccgcactaccctggagtgcgtgtctagctcacaatagtgtcacaatgtgataaaccggggtttcgaaccctcagataattatctacacccattactcacctcaagtcggctcgaaaactagcccgaaatgccttttcccttcaaattcacctctccgagggacgaatctggtcaaaaccacaacgaatacattacataatgccaatggaacataacccaatcgaaagaactcgaaaaacaacccaaatcgcgaaaatagcaaaacccgagccccgggcccatgcctcaaaatccagaaaactttacaccaaaacgaccctcgtctcgccacgagtctatacatataaaacatcaaaatcggggtccaattgctcctccaaatcctcaatttacattacaaaactcaagccctagttcttcaatattttgcccaattttcagagaattaatgggtgattcttcaataaaatgatgtttcaaggtcaagagacttacctccaatcaatcccaggtgaaaccctcttcgattctcgtcaaaaagctcttaaggttgctcaaaaatggtggaaataagctaaggctcgcggatgaaataataacttaaaacattctgcccagacgtcctaactcaatgcgttcgcactcctacagtgcgttcgcatagaacaaaatctcccaggcctcccttccttctatgcgttcgcatacactctatgcgttcgcatagagtaaacttgaccaggcctccagctcctctatgcgttcgcacatggacagaacaccagtccactgccctgccttccttcaacgcgaacgcattgcacttccgcgttcgcatagtgcaaactgaccacccccaagaatccttctatgcgatcgcataagggccctgcgatcgcatagagatattttctctacaacagctgactgcatttctgcagcacttcaacaaccaaaatcaatccgacaaccatccgaaatcaacccgaggccctcgggacctcaactaaaagcaccaactcaacctaatacttcattcaaacttgttcggaccttaagaatgctaacttaaacatcaaaatcaccaaaaatccacaaattcaactctaagacaagcatgaacttaacaaaaccatatccggcgccgaaaccaaccaaacgacatccaaatgatctgaaaatttgcaggcatatccaaaatcacctaacgaagctaatgcaacttccgaaattccattccgaccctcggatcaaattctcacctatcacccggattcttccgaatttccaacttcgccaaacctagctaactttcactccggaactccggattcacttccgttttcactactaagtcacaaatcaacccccgaaactagtcgagccatcagaaatccattccgagccctctaacccataagtcaacgtcgggttgaccttttcaactcaagcttctcttaaagagactctttaacccattcctatccaactccaatccaaaccattcccaactcaccgaatacacataacaacacacggggaaacatatgacggggataacgggctaaaatataagaaatgatgggtcgggtcattacagtccgagcctcgagtttggaccacatgggcccggtgtcagatttttaggatttttggaggaaagttagggatttcatttctaagctatggtttgttgtttttgagctattattgataagattgaatctaattatgcttagatatcgttgtttgggagttagattctaaaggaaaggcggttgtagagctttgaattgctagtttcggaatcgaggtaagtgtttgatctaactttggttggagggattaggatgaggatattgattgttatgtgttatgtggtgtcggtgtataggtttggtgacggttacctatgcacttgagtcaagcatgaccgtgggtctttaattgatatcgttcgatgctataacatggattcttgttgttgaattgattctcatgataaattgttgaagttgagtagataagatggcttaaatgaggatttcaagtataataccttgccgaactatgtgtaactctgtgtagtctctcccttgtcgggatatttggttgatagctgcacccttgccgggtttagatatatatgttgatgtgatttccctaaaagggaccctgttgtaaatatatggaatttggcatatctattctattgggatcgtgtggcgcgccgtccacttgaatatactattctaggatcgtgtggcatgccgtccacttgaatatactgttatgggatcgtgtggcatgccgtccacctgtgaaacatgatattgggatcgtgtggcgcgccgcccactattatacactaaacacgggatcgtgtggcgcgccgtccaccatgtgctttctgttttaaataaagtatccgtacttttgtaatgtttagacctgtacatttctatcttaaactgtttccccctatagcatgttccctcccccgtgcctatttattctgtattattattatttcctgctttggtatatgtatatcttgcacaggttaacgctgtaggtcttgtctagcctcgtcactacctcgtgagccggggttaggccaggcacttaccagcacatggggtcggattgtgctgatactacacttctgtgccctttttatgcacagatccgggagcagcctttagagctgtcacgaccctaatcccggtcgtgatggcgcccggccgcaaggctaggcaagcccgacctaaaacaacccaacataggcattccagcccaataagaaaacaatttccagaatttaggcaacaaggttaatattaaaccgcccagtcagggccaagactgaatgaaaagacaactgaatcaataacaattccccaaaattaagggtcacgagtactgagcctctaaatataccgtatacaaactgatagagaagatacaagtcaaaatactggaaagaacataacaaggatcggagaagaggtcctgcggacgctggcagctacctcaatactctgaatagtctggaaccaacgacaactgcaaaactatgcctcagcaacacctgaatctgcacacaaggtacagggagtatggggtgagtctaccaactcagcgagtaatgagattatgtaaatacccgaaagtatgaaatccaaataaagcacatagcgaggctaaacctcaacagtcgtaacaatttaaccatgcaaagaaacagataatagcatatgaatatgatgcaatgcaatgcatgtccactgcggcgtgcagcccgagccatccgtatgggtacccgcgctcactgtgggggttcagactccggaggggctcctacagcccaagcgctatatcatcagatatatcatagtgccaatagttaccactgtttccttttacaatccacggtgtcaatagttaccaccgtttccatgagtcatgcacagtccagaaatagagtaaaatcaatgatcctcagtccaattaacataaaaggtatttaagtttttcaaaaacgtatcactgtggctgagttttaccaaaatagagtttcaaaacttttggactgtgttcaaataaagtgcataacatgataatgcaataaatatatccctgaaggattctacaagtcgacacaaggccccaatcatggcattaagcccatatcaatccctaaaggattattcaagtcggcacatggccccaatcctggcatttaagccatatatcatcaatatagtacgcgtagcagttgctaatataatataatttatccctcgggttgagccgagtcacaattctcatctcatacgaccccgcactaaccatggagtgcgcgtctcatcatcactatagcatcgcaaggtgatttaccggggtttcgaaccctcaggtaatcacatacacccattactcacctcaaaccggcgaattctcaagctcacgacgcctttgcctctccattcggccttctcgcgcgtcgaatctaaacaaaaacggagcgaatgcatcacaatatgcaaatgggacaatacccaatcaaaaacaaccaagaattagccaaaatctcgaaacttgcaaaacccgagccccgggcccgcttctcgaaaaattatgaaacttacattttcggaatcctcgtcttgccacgagtccgtacatatcaggttcatcaaaatcggagtccgtttggctctccaaatcctcaatttttgtttcaaaaatccaagccctaaatcttcacattttagcttaattccattaatttacaagttaaatcttcaaagaaatgatgtttctaagtcaagacacttacctctaatcaatcctcttcgattccctcttcattttgctccaaaagctctccaaaaatcgtccatactttgaagaaatgaaggaaaatgagctaaacccgctaaaatatcattctgcccaggtattccttcatcgcgatcgcggaaattgctccgcgatcgcgtagaacaaatttttccagcccagtttttacccttcgcgatcgcgtaaaaggcttcgcgatcgcggagagcaattccagctccccccggacagccttccgtataatggccataactttttgtacacaactctgattgacaaatggtttgatgttatggaaactagacacaaagggctataactttcatatgttactcatttcctgaatccttacatattgggagatataatcttccaaactcatctatgtgtattagagactcttcccgaacaacctatagtgtaacgtcgataactttttttaaagatgtccaaattattatttctttacctttctgaaaactagactcaaagatctacaacttttgttttggaatcacctcaaaattccttgtagataaaaagatatgatcttccgaagtagcaccaatgcatcagaaacctttcttcttcgcgatcgcgaagcactgtacgcgatcgcgaagcactgataaattttgagcattttactcaccgcgatcgcgaccaactccccgcgatcgcgtagagtactgctgtggccaaaaaccagcaataaaaaatggcctagaaatggcccgaaaccaccccgaaactcacccgaggcccccgggacctctaccaaaagcacaaactcatccaagtacctcattcaaacttgctcgggtcataaaaacgctatcattatcatcaaaaatcaccaaaatcctaagattcaattcaaactttaacttaaactttccaatgtcatatccgatgccgaaaccaaccaaacgaagtccgaatgacccgaaattttacagacaagtccaaaatgacataacgaagctacatcaactttcggaattccattccaaacctcggatcaaattctcacctatcaaccggatttctccgaaattccaacttcgccaaaataggctaactttcacaccgaacctccgaattcacattcgttttctctcatggatcataaatcatcccccgaaactagtcgagccatcggaaatccgttccgagccctctaactcataagtcaacatcgggttgacttttccaacttaagcttccttaaaagagactaagtgtctcaaaccttaccaaatcatccacgaatgacttcaaattttgcacacaagtcacattcgacattacggacttgccccaactttcggaatcgcatttcaaccccgatatcaaaattttcactttcggtcgaattttcttaaaaccttcaaatttctatctttagccaaacgactccaaaatgacttacggacttccgatttcacttccgatcgcgcttccaaatccaaaatcaccatacggagctactcccagtctcggaatcccaaacggacatcaataacactgaaatgcattttaagccaaattgatgcaaatttcttcaaaaatgctatcttccacaataggcgccagaatgctccccggttatccaaaacccgatccgggcatacgcccaagtccgaaatcatcatacgaacctgctggaaccttcagatcccgattccaaggtcatttactcaaaattccaatcctagttcatttctccaactttaagctttcaaaatgagaattcacatctaaatttaactttgatcttccagaatctcaattccgaccacacacacaagtcgatataatcgagatgaagctgttcatggcctccgactgctgaatgacgcgccggagctcaaaacgaccggtcgggtcgttacaatctcccccacttaaacatacgttcgtcctcgaacgtgctgagaactacactgaagtagtctgaaatcgcttgactaacacctcatgcaccttcccgtgctaccacaactcagttgagcacattagctcgataattctgcagatatgcccctttatttaagaaaataagccttaaagcctaattccaacatccagaatcatatgcccgacctggttccaatcatacaattaccacaccaatcactacacattgtacccaagcatgactgcataattgttgctaaattcacactttgcattactttactcataggaccacaataacattctttaaacataatagtcgaaattccacaaatttgatgctcccattgcatatcatgacctacataggtcttgctctagctttgcaacactgatacgatggaagagatgccaaaattcataaccaagtgctgaatcatcgatccattgggactatactcctgacaaacaccttttcctcctcgagtggtcataattccacgtggccttgccacaacacgcgatcctatctcaactctgttacacatgaatcacctcatgttaccatgctcaaagtagacatccatgcacagatcgatgcctgaaaccaaatcacccatcacactcacggtgaaacaactaatataaatcattcagtcctgaaaggacacaaccgatacgctattcgccaagcaattctcaatacggatttcatagcataatcgtttagaataatccgacactggaaaaatcactctacatccccataacatatccagaatttagtatactaagcaaggaaagatccactctgcttccgaattcccaatagctgctaacagtaccaacacaacacacgatccacaaccaccgcatagactgcacaggagaactcccagtctccaactactcatagcacacgaatcactgtacctaatccaaatttccacaatacgaattacagtttacacctcaagtacccaaccattccatgaaagatattctaaaactcccttgccatcaaataactcagatacccacagtcgatcccattatgaaataccgtaacactattgatgtatcatttgtgaaattaccctctttccgaaacatatgccatttccaaatcacttccaattaacagtgccaattccttgattaccttaagctactcattacctaagacttagccaaatccaccgtacctttcaaaaccgagtcgaaaactcgcacacgccatatcggtcctttacaacataccgcatacacaatatcctccaaggatcacacgagaacttccatttctcttctgcgccgcaaacattgtcgcacttaactagtctggaacttgcattgaccccatttagaaggaaattattatacctctcgtgacatcccttatccgtagaaaaatgcatctcttcaaccttgtattaatcattacgaactctcccaattctatttgtacaactaaaccgccgtggctgaatccctttttatttacaacccgctaagagaagcatcaatacccaagatcattgctgcaaacaattacatgtgccaccaacccattacctcgcatacacaacgagaactaatcatacccttaatacgccgaatccggtccactaacaagctacttgatttgcctagattctcacctgattcattatcaacttgatatactctcttgctatagcaccacaatgcctcaacccaagcttactgtacgaatctcaccaccagaccacactgtctaagtcccatatgccactgaatattttctcaagcgttctcataaataccacatctcccaagtactttgcccaaagaacttcatgcgacgttgctcttattttccaagtactgatacataaaatcccgtaactatataaaaataccacaagtcttgacctgtgctaaggaaaacactgacttggccacctactcaaccttcaacacctgagtgatacatatcgaatctcgatcacattaaaaccattctcaaaagtcacccactcttatacacgctgcaaagcgcttgacttcatgaatcgaaccactcgtgccttatcagcactctgacaccacaggacgagatcttattctgatacaaccaaacaaatcccttctctttacattaagcattctttacccacaactcaatacatttcctcattttctcacatctacgaagcaccattgtgccatcctcggctcactttctgcagccataactaattcactcacatgtatcaaatcggaaccaacacggtacataaccgtaccaccagctcattaacagtaacctccccaacttagctcgaagccatatatattaaaaatacacatactctatagcctatctcaataacatggcgagatgaaactcactctttcataagcttgtgaaatcatgaatcatcagaatttctaactcttctgcaattcttgcatccagtcacacaaccgttaagttcatttttaaggcaacaaaattttcactaagtcccagatttttcgaaaatttcggcagagtttcctttgtaactgggcctatccacctgtcagagaaccaccaaaacatcctaacaacacgttcaccacctgacaaaacatcacaacgtatatcaacaacactaatctcaatgctacatgtattatattatcaaaattgatgcctgaacatgcgttgcctctgtccgaatcataacatatagaaagtaccttttaattacacatgagatctactaacatacacataatgatcataccatttcaaaataatctgcaggagtcccccacctgtttgcttcaatacaatactttggtacattatccaccgccatacacattacacaattacccagcaaaccttcttcgatactaccaagtcatacaaacacatcacacggcaccaacatactcatcatgaagctattcagccgccattaccacaattggggacaatactgaacttagaagctcataacactaactcgcgcaatcagcaccttggtgctccagctatagacaaggattcggcctcaagtcctccagactagctcaatatcaactcatagaaaatcaccactcgcccctcgatcgaggaatcaacagacatcgaggcatatatattactaggcgctcacgggcgcacacaaacgtgaggaaggaatttcaaaagttactctttcaagctgaatcaaggacgcacgataagaattccaagaatgtgatgttttcctaaggttctgtagcctcccgtggatatgatacggacgtctacgtaccgatccacaagactctactaaaccggctcataactcgtgaagcctagtaacctaggctctgatacaaagttgtcacgacccaaattccggtcgtgatggcgcccggccgcaaggctaggcaagcccgacctaaaacaacccaacataggcattccagcccaataagaaaacaatttccagaatttaggcagcaaggttaatattaaaccgcccagtcagggccaagactgaatgaaaagacaactgaatcaataacaattccccaaaatcaagggtcacgagtactgagcctctaaatataccgtatacaaactgatagagaagatacaagtcaaaatactggaaagaacataataaggatcggagaacaggtcctgcggacgctggcagctacctcaatactctgaatagtctggaaccaacgacaacggcaaaactatgcctcagcaacacctgaatctgcacacaaggtacagggagtatggggtgagtctaccaactcagtgagtaatgagattatgtaaatacccgaaagcaggaaatccaaataaagcacatagcgaggctaaacctcaacagtcctaacaatttaaccatgcaaagcaacagataatagcatatgaatatgatgcaatgcaatgcatgtccactgcggcgtgcagcccgagccatccgtatgggtacccgcgctcactgtgggggttcagactccggagtggctcctacagcccaagcgctatatcatcagatatatcatagtgccaatagttaccactgtttccttttacaatccacggtgtcaatagttaccaccgtttccatgagtcatgcacagtccagaaatagagtaaaatcaatgatcctcagcccaattatcataaaaggtatttaagtttttcaaaaacgtatcactgtggctgagttttaccaaaatagagtttcaaaacttttggactgtgttcaaataaagtgcataacatgataatgcaacaaatatatccctgaaggattctacaagtcggcacaaggccccaatcatggcattaagcccatatcaatccctaaaggattattcaagtcggcacatggccccaatcctggcatttaagccatatatcatcaatatagtacgcgtagcagttgctaatataatataatttatccctcgagttgagccgagtcacaattctcatctcatacgaccctgcactaaccatggagtgcgcgtctcatcatcactatagcatcacaaggtgatttaccggggtttcgaaccctcaggtaatcacatacacccattaatcacctcaaaccggcgaattctcaagctcacgacgcctttgcctctccattcggccttctcgcgcgtcgaatctaaacaaaaacggagcgaatgcatcacaatatgcaaatgggacaatacccaatcaaaaacaaccaagaattagccaaaatctcgaaacttgcaaaacccgagccccgggcctgcttcttgaaaaattatgaaacttacattttcggaatcctcgtctcgccacgagtccgtacatatcaagttcatcaaaatcggagtccgtttggctctccaaatcctcaattttcgtttcaaaaatccaagccctaaatcttcacattttagcttaattccattaatttacaagttaaatcttcaaagaaatgatgtttctaagtcaagacacttacctctaatcaatcctcttcgattccctcttcattttgctccaaaagctctccaaaaatcgtccatactttgaagaaatgaaggaaaatgagctaaacccgctaaaatatcattctgcccaggtattccttcatcgcgatcgcggaaatttctccgcgatcgcgtagaacaaatttttcccgtccagtttttacccttcgcgatcgcggaaaaggcttcgcgatcacggagagcaattccagctccccccggacagccttccgtataatggccataactttttgcacacaactccgattgacaaatggtttaatgttctggaaactagacacaaagggctataacttttatatgttactaatttcctgaatccttacagattgggagatataaacttccaaacttatctatgtgtattatagactcttcccggacaatctatagtgtaacatccataactttttgtacagatgtccaaattattatttctttacctttctgaaaactagactcaaaaatatacaactttcgttttggaatcacctcaaaattccttgtagataaaaagatatgatctttccgaagtagcaccaatgcatcagaaacctttcttcttcgcgatcgcgaagcactgtacgcgatcgcgaagcactgataaattttgagcattttactcaccgcgatcgcgaccaactccccgcgatcgcgtagagtactgctgtggccaaaaaccagtaatcaaaaatgacctagaaatggcccgaaaccaccccgaaactcacccgaggcccccgggacctcaaccaaaagcacaaactcatccaagtacctcattcaaacttgctcgggtcataaaaacgctatcattatcatcaaaaatcaccaaaatcctaagattcaattcaaactttaacttaaactttccaatttcatatccgatgccgaaaccaaccaaacgaagtccgaatgacccaaaattttacagacaagtccaaaatgacataacgaagctacagcaactttcggaattccattccgaccctcggatcaaattctcacctatcaaccggatttctccgaaattccaacttcgccaaaataggctaactttcacaccggacctccgaattcactttcgttttctctcatggatcataaatcatcccccgaaactagtcgagccaccggaaatccgtttcgagccctctaactcataagtcaacgtcgggttgacttttccaacttaagcttccttaaaagagactaagtgtctcaaaccttaccaaatcatccacgaatgacttcaaattttgcacacaagtcacattcgacattacggacttgccccaactttcggaatcgcatttcaaccccgatatcaaaattttcactttcggtcgaattttcttaaaaccttcaaatttctatctttagccaaacggctccaaaatgacctacggacttccgatttcacttccgatcgcgcttccaaatccaaaatcaccatacagagctactcccagtctcggaatcccaaacggacatcaataacactgaaatgcattttaagccaaattgatgcaaatttcttcaaaaatgctgtcttccacaataggcgccagaatgctcccgggttatccaaaacccgatccgggtatacgcccaagtccgatcatcatacgaacctgctggaaccttcagatcccgattctgaggtcatttactcaaaattccaatcctagttcatttctccaactttaagctttcaaaatgagaattcacatctaaatttaactttgatcttccagaatctcaattccgaccacacacacaagtcgatataatcgagatgaagttgttcatggcctccgactgctgaatgacgcgccagagctcaaaacgaccggtcgggtcgttacaggagcgctgcagcagtagatagggagccagccttcagtccagagactgctaggtagttcacttgtgttcgtgggccctccccagtctcatcctattatgtagtttgtttatcatttcagacagactaattatgtatttctttcttcaaactcttgtatgtagtaaatcttagaagtccgttgtgctgtgacactatgtttctgggtagaggatatcatatgtttgacttccgcatttcgttctatctttaattaaatttgagacttttctttatgatcaatcgctgtttccattcattatttgttgaaataattagttgattattccttgtttggtttgtttgcctagctccgatagtaggcgccatcgcgaccccgatggtgggaatttcgggtcgtgacagtttcggattgtgatcacgctctcatttgatgttccaacgccgtatctttgggcataaaggggtacaatcactacaaaaaaattgtcaaattatggcggtttatttatgggggtcataaaaaactcccattatatatttattttgtggcgtttgagccaacccccacaaaatagttcttattgcggcggtttaaatgtgggagttataaaagacccctactatatatttaatttgtggcgtttgttccaacctcctcaattttttttcttattatggcagttttttgcgaaggtttttgataacctccacaatatatcaatttcagctgtttgagaaattgttgcaattcgatacaaattaatgatttgactcatgcaaatttttagttatttttttcaccttatttctttaaaatttaatcaaattacatattttagttaaaacaactgcgaattaatgcaatttacatcaatatctataccttctagtttgtaatctttttctcctcactttcttcaactacaaaaagaagatatgaggtctttcatgatctctctctgtcttgctcgcttgtttttcatttattgtctttgtacatttctataattcgtctctttatctttagcaaaaaataaatagacatctatttcattttttcctcatagctttttattagattatacgaaatgtctacccgtaaatactaaacataatttctaaccacgtgagtatcgtgaacctttaggtgcaaaaaaagaatgtgactggcgttggaccacgacaatgggtaacaaaagaataatgcaaaatgagccatcacaaaagttgaggtgtggcttaacaaaagtaatactattacttttaggatatacttcttaaaaatttttattactaatttaatttgaaaacatatgataatgtcctattactaatttaatttgataatggtattatattgtccaaatttatttagaaaaaggagagcatatattattataaaagcataaatacaatattaatttactaaaatagccctacattattacatggaagaactcatatgaatagtacataactgcaataacctatattttggactataataccttatatgctaatttttaatatataaaattttaaaattgataaaattttgtctattagatgattattaaaaaatgtaggaaggtttaataaaatgaatttcataagaatcctccgtattggcaatgcattaccactccataatgtccaataccaagaaaaatataaaagtaatattaagtggactgcataaagagttggaattggaaaaaaatacccccacgacaatatatttttatattatattcgaactatttttctactcaaataatatttttttttatcaattttcatataatattgaaaaatacccaattgtaaacaacaactaagaaaatttaagaatataaatgtgtgagaaagataaaaaaatggttggtaggagtcaatacgacttatgattctacaaatataaagatataaaagtgaaatatcatatcaatattttactctttgaaaataaaatttatggtagataaaattataattaagatcaaatattcaaaacaagagatgaactaatattaatcttaaatgaacatacaataaattattttttatgttaaaatcaaataataaattttcttaattaattatttagcaagataatccaattcaattattttttaaatttattatatgagtaaaattcttattcaaataacaaaaatcttaaggtacacaatttaattccataaaaagagcgttagaacacaaagtataaaggttagtatattaatagactaagttaaaattgatcttccattgtatataggttaaatttgaagaaaaatatgctcgtcatgctactgaaaaacttagatacgccgaataacttatgtaatagcacacatatattatataaaagttttgacaataacgtcatacatgcaaaaattataatattggttaatgtgcttctaagtatattcttatccctgaattcaactttcgtcttccgaaactaaggatatccttttaaatttgtgtgagaataatttttagtatatttttattttgcaaatataataaataaagcacaggacaaacatcctaaatattggactatatttatcgcaggatattttcttgcacgaacaattatatgtttcactttcgagagaaatatcaagataaacaacaagagttctggtaaaggcagagtagccaaagcattaggaggaaacatacacaaaaatatattgtccacgaagaagtgttcgttaagaaccaccacattaaataattttagactataactcatacggaaatgggccaaatacccccccccccggactttacgataaggtctatatataaccctcgttaaaagtttggcccatccccaaccttgtcgttacactattggcctaaataccccctggactttacgataaggtctatatataaccctcgttaaaaattggcccatccccaaccttgctgttgcactattggcctaaatacccccttttatttaaacggttgccacaatggataagttatccactcaaatattacacgtgaaaattaatatacacacaaacattttattttaatgcctatccctatccattaaccctgcccgttacccgacccgtaagtttaaacccgtctcttaattaaccctacgcttttcttctcaatctcaacaaggaattcacagagattcagtagacataaagtcattagtatcaaaaaacgcaccatcttcttcatctgtttcaatctatttgaaaggaaatgtaaaaaatccacccagagttttattaattgcttttcactgcaaacttgcataaaccatcctcagctgtaacagacgaaagcctctttgctactgttcgaacacacctaataaaaaggtgtaacaggcagtggatcttttgcttttggcaaaattacaatatgttaagtttagtaagtaggaagcttctgctaaagcttttcatagaaatcactttatagataagcacatggtttcctagtaatgagagaaaacaaagttaataaagagaaaaatagatcaaaagaaagcagggggttaaaaaagagaattccaatatgtatttgtagcaccagctctgtgagttccttgttgagattgagaagaaaagctgattgagaagaaaattgtagggttaattaatagacgggtataaacttacgggtcgggtaaggggtaaggttaatgggtagggatggacattaaaataaaatacttttgtgtatattaatttccacgtgtaatattttgagtggataacttatccattgtggcaactgtttaaaataaagagggtatttaggccaatagtgtaacggcaaggttggggatgggccaaatttttaacaacggttatatatagaccttatcgtaaagtccagggggtatttaagccaacaatgtaacggcaaggtggggatgggccaaacttttaatgagggttatatatagaccttatcgtaaagtccagggggggaggtatttggccctttccgtaattcataattatacaactaatatgacaaaatcgatcatttgtgtaagttttaatttgatgatgtccttttattttaaattcatgtattatgctaatgtaatagtatttttcggcatttagacgattgttgtattattatacataaaatttctgtcattaattaaacctttttgttccttcgtataaattatcacatgcaattattaactaccaacgcacgttcgtagatgctagtatattaaaagacgaagacccttagcaaaatatcgttcgattgttttactcttaaaacatacattggataaaattgtaaactcaaaaaatttcctactctttaggagtgtccgaatttattctatgattcaactaaagataacttcaaatcggaatcgtattatgtatgattagaagtttgatttagttcatagactagttatatttgaagtcaaagtcacaatatatggcttaattaagtgatctttaccggtaattgctgggaaaataagttttatctagttatattaaaagtatgaaggcacctagcgaaatgtcgttcgcctttttaatcctttaaaaattaatttcacactagataaagtagtcacttcattattttcctatagttaggaatttgaaatcacctaaaatttggaaccttaaatcctttcttatttgaactcggtagaaactcctaatatataaaaatttatagtaattgattattacattgtataaattatttccttgtttgaagtactaaacataagtataattaacatatgtcacgttaattttatgactctttaggagattgaaattaacttaaattagttctaatagctcaaaacgtggaattgcagcaaattgaattctcttgtaaatgtaataatgataactaattaaaccgatgagaaggtaaaaaaccgcttcactattttcctttttatttccctcgttttttccctctttttttatctcaactactagataacttctctttattcccgccctagtttccctccatattcccaccttcccctcgacccctgttctcccattttgtgcgcaagaaacttccacttttacacctatatattcacgatacagtgcctcttgaagatatgaaattcctggaccctggtgagtatattgtacttagtttatttattttgttttgtttggagtaaaaaaaacagatgccgtgtgacgacccaaagggtcatcaccgtaattctcccttgctccgtgcttctgaggcctcaaaaacctcttgaggggttgcctcaatttgcgtgcgcagtccgggcgcgaagccggaaagctttgttgctaagaaatttgaatcgtatgtttaaaatgataaacttcaaatataatattgatatggttgacttcggtcaatattttgggcaaacggacccggacccgtgatttgacggtctcggaaaatccgtaggaaaatatgggactcgggcgtattcccggaatcgaaatccgaggtcccaggcccgaggaaacaatttttcagtttaattgattgctgttaatgttaaaggaaaatgaatttgaaaactgaccaaaaggtaatggtatcgggctcgtattttggttccgacgcccggtacaagtcatatataatggttaagcgttgtttgtgaagtttcatttgaatcggacgtcatttgacgtgtttcgtacttgaatatgaaaatcttgagtttcatgtgttaaagagtgaaattatgattttggggtttaatccattgattatgatgttattttggcgatttgatcgcacgagtaagtccgtagggtatttttgaggtagtgtgcatgtttggtttggagccccgagggctcgggagtattttggataggtgtcggatgcattatgcatggttggaagttagggttttcatattttgagcttttggacctcgatttgaggtccgatttcaattctaattatagttatgagctcgtgggggaatgggtaacccggttttggtccgaacctcgagtttcgaccacgtgggcccgggggcactttgggaatttttgagtaaaactttgggaaactcattcttatgcattcaaattagtttaattagcatttgttaattcatttgggtaatttatgattagatatcgttgtttgggagtcggattctagaggaaaggcggtgttagaggcttgattgctagttcgacatcgaggtaagtgtttgatctaaccttggcttgagggattaggattagggtgttaattgctaagtgttaattgtggagtcggtgtatggttatctatacacccgagtcaagcatgaccgtgggtctttattgtattaacttacttgatatgctaagaacttgttgcttgtattggaatattcatgttctaaagataatctctaccgaatgtgaaaggttaatgatgtaaatgtgccacttgaataatttggagtatttgctcgacctagggcttaggaatgtagtgttagctatgcattgataattatttccttgtcggatatagacatatgtgcattggtgtcccccatgatgggatgtttgggctgataattatataaatgttgaggatcgggttgcacgccgcaacggtatgatacatgaaataaatacttcggaagggtcgggttgcacgccgcaacggagtatgaattgatgattttgtgcttatgttgagttaaattggcatcctctcatcggttattaattgttctgctctggttctttctagttgcgttctgtagttagattgttgcacccccacaacatgtcccctccctttattattgtttagttctacatgttcttgtcttgtatatgtatattcttgcacaggtttatatgctgtaggtcctgtctagcctcgtcactacctcgtgagccggggttaggccaggcacttaccagcacatggggtcggttgtgctgatgctactcttgctgtgcctttttgtgcacagatccgggagtggccttcatccagcagcagcagtagtagtcggggagcgcgccttcagtctagagactgctaggtagttcactggcattcgtgggccccctcagtctcctcctagttgtcatttgtttatcatttcagacaaatgcttatatatttacttctttcaaaccagtggttgtagtaacttcttagtagaccgtgtgtgctgtgacactagtttctgggtagaagatctcagtttatgctatttccgcatttcctttctgtctttaattatattggagatttcttcattattagatgctgtgtctatttggtattttatcgaggtttatgagtgtttaatctttgctgagtggcttgcctagctccttcagtaggtgccatcgcgaccccgatggtgggaaattcgggtcgtgacatggtgtgaggctctagattgggtttgttggatagtttcagaacaatttttgtatcatcttttgtctgatgtttagttcctattcatatttgattcacctctctctctttttcttatgaatacgcagccatgccgaatattaaacgttttcggaatccactaaagtcagctcgtgaacaacatgatgctcagggacattcttcatcattagcaactccagtccaatcatatactatagagccctcaacaacagtacaagccctcccacctgctcatgaagtcccgcaacaagaacaagctccaattttgccttctaatttaagtacaacatctcgccgtacaggacgtgaatctccaaagtattggacagtagaggcaaaaggtacatgcattacgtttatttttacttcaatttatgagaatcttatttttttcttcctttttggttaagtaacttgttttattgttaaagattcagaaaatgctaccaagcaaattagggtcaaggtcaatgaagttaacaacctaactgttggggagcgcatcattgtgaattttgatgactacaatgcagcatatggtgaagcgcaaggattacttgctggatattgtggatcgctggcaattgattgtaatttgtttccaattagttttgagaagtggtcagggccatcgggcatgcctaagaagtacatgaaagactgttttgaaacaatattgaaggtacaagtgttattacatacatatgtacttattgcacctagagttttataccatgaaaaaactaatttccagtttttgtttgaagcctcaatttgattttcgggtaagtgagtccattgcatatagatactgcaatgctagtcttttgaagaagtgggcttcacataggcagaagttgtggaatgaatattatgacccgaccaaaagaaaaaatgaaattataagtaatgtgccagcaggtataaataaagatcaatgggccatttttgttgcttatcgtcaaaaaccatcaacagtggtaagattcagattattttaacaagtttcatcataattaaatgaagatgatgttctaaatttgtatttgtttttgttgataggagctttgcagaagaaataaagaaattcgaaagcaacaaaaaatgccacacactggtggttcaaaagctaactcgagaagacgatatgagcttgtatgcacattaccttattaagtttattttttctctaattaaaatgttttatgataacttttttaatacatttcttttttagtttttggaaactggaaaaactcctagtcgtggaaaaatgtttattgaaactcataagaaagctaatggatcatttgtaaatgatgcggcaaggactataggggtaagtctagatttgatgcatttttctaacatcaatttcattgttttgtctaacattctgcaactcaagtcttgttatcttgtacttactaattgatattttatctgcttgtaggaacaaattgaattgaatatgactcaatgtgatactaatgagtgtgaagtttccccaaatgatgttattggcaagatgttaggggcagagcattctgggagagtacgatgtatgggtatgggagcatctccttcgaacacattcaggaatacgaaaggacgacttaatgatccgagtggtcactacaagaaaatagagatatgacgacatttattaaatgtcattttaagatgctgaaatgtcgcaaattcgtttagcgacatttattttacatttgcatcaaatgtcgtaaatttcaatgtcgttaatttttcgacatttaagtaaatgtcggtatgaattttacgacatgtagttaatgacatttacgtaaatgtcaataagaaatttacgacatttaatttatgatatttaggcaaatgtcagtaaattttttacgacatttagtttaagacatctatgaaatgtcccttaaaattaccgacaattttctttaatgccagtaagtaaatttacgacatttatgaaaatgtcgtatccacatttacatgaatgtcaaaaaccaattagtgacatatctttttacaactgtttcaaatgtcgtattaaaaatttcgacatttagattaatgtcggtaccaaaattttaaaatattaataataatcctctattagtttcatcagaatactttgcattcaatttgtacattcacaaatgtcaacctttataactaacttgaaatgtatgtaaaacaaatgccttttaatactataactaaagaacaaagtcgcggtataaaaagtactccgtacaagatagatgataccaaatcaaatgatttgttctcaaagtaaagctcaacttcaactaaaagatggttatttccgcatgtaactatgttaagatcactcctaattcgaatgaattcccttaacttctagactgaatcctgtaacaaagcttgttgaaaccaccactccacaagtcaagattttcattgccagtaattgacttcacttccttcaaaaatgctgcacgagaagtcacacacaaaaaaaaaggaattataactataataaagggaattccttcctcctcgactataacaaattgggataccaaaaaaacaacagattggcattctaaaaaaacaaacatattgaataatgggtataatagcagcaactgaagagagaaaagaaacagagaaaataaggccaaaaaaaaaggaaacaatattttataatattatcaaacttacccatttttcctttgtgcctaggttacgaattccagtcttcttgattgtttaacttgagaagaacattaaattggttattttgatagtgtacaacattcaaaacttggcaaattatagaatattagatacaaaagaagaagaagaagaagaagaagaagataaagccacataatatttttcatgttatgaaagatactttattaagtataagaagataacagtacatgacagcatttaccaataggatcaaacaactttgatataaattcttttaccaagttcgagtaaaagcaaaagtttcaaatgccaaagatgtttcctactcttcgaatctaagtataaaaatatattgtttagacaagtgtacgaactaaccttatatgtttgaacaactcaaatataggtgatagtgattgttggcgatcttcaattgagttatcagaaatctatcacaaaagagaaagattattataactaaaagaaaactaaattataatatcatcttatatataataatttcttatgaataagcacaacgttgtttacctgctcattacctgatgattttcaatttgagacaatgtattcccagctttactttatcgtctatttttgcctccatatcctctgttgcttcaggaaacttattttccatcatttttatttcttttttttgcttcagataactttttctctgtcgcttccatttcttctttagcttcagacaacttctccctcatctcaattcttatagcaggtagctttttgaacttctacctgctctcaatatgaatagctttttgaacttttaccttcacgattctcactcaaatagtaaatatgcaatattaagactcgatatcttagttaatctgaatcttcatatttatgtatatgaatagaacttttatcattctgtagacaataaatttgcgtcgagaaaataaaatcaagaccgaaaatatcgcaacaatcgtatagtaaataaattcaagggcctttgagcttgatcttgaatatgtaattgttgtctcgaacgatgatcttgttcttgagcttgaacttgattgcttgaacttgactttgatttgttcttcgttcttgaacttgaacttgatttcttcttcgttattgagcttgaacttgctttcttgaacttgaacttgaagcttgaaacttgtggaggaatttgcagcgtttgatccacgagctctttcttgcttcttgttataacttctggtgtcttttttgagttatgaagtcccctatttatagttgtggaagggaagaatcatgataagaacaaactctttccgaccaatcaaattgaagtgtgacatggccgcatttgattggccagaacatgtcacttgcacgcgtggcgcgatttcatcggccttttagtgtgactggacatgccttgtcattttgacacgtggcatggtcctattggctcttccgcttgacttggcatgccacgtcatttcacgcgtaacaccaaactgggcctctaggaaggtgacattttgggcttagtgaagtgggctcatcactttagcctaattaaatgggctagcccaattgattaagacttatttatttaatccatatatattggacttatataattaatccaattatattagcccataatatatatttggaccaatatgtcttgaatttaaaatatagaccaaattaattttatggatttaaatccaataaattttgtatgcctacacattcatttgttaaattattttgagggtcaatattactacttataaaatttaacatatgatttacataataactcccgaatactgaggataagcgtgttcaggatgcacaatttgacatttggggcataagcctcacacataagccgtcgcaacaagtgcctcgcccaagagtgagtcatggacgagtcccaaaaagacttttaaaacgttaatcgacaattgcataattcgtctattcgaaggataaacatcacaatattttaaaaaatatataataatatgaataacgatattttaattctagacaaagaataatataacaattaaaaagtacagaaattttcaatattagatatacatgtgcgtaattatcgactgattatatgacattcaaagtaaaactctttttttttatatttgtatcaaaagtcataacttttacgatatttgttcagacatcgtgttttttatattttatatcaaatatcattattatttttttgttttattgacatcttatatcaaatgttattttttgcaacatttaatatcaaacgttgtagtttgtacgacatttcttcataaatgttgatgtttttgcgatacttcttcataaatgttgttgtttttatgatattagtatcaaatgtcattttttttacaacattttgtatcaaatgtcatttttttatgacatgttgtatcaaatgtcgtaattttgatgacatttcttcattaatgtcgtcgttattacgacattttgtgtcatatgtcatattttgatgacacttagtatcaaatgtcgttgtttttgtgacattttgtatcaaatgtcgtagtttttacgacatttgtccataaatgacatgaaattcacatttttccgacatttatttcaaatgtcgctaaataaatgtcgtcgtatcctcactttcttgtagtgggttcttcatctagctacggtacatcatctgcagcatatacccatttgcaacaaaagcttatgagcgtggaatcccgacaagaaggcaccttaaatgcaataaaggcttatgtgatgtcaaaggaaggtgtggttcctgaagaatttgctggtctgtttgcgcttcaaccagaggtaagaagtaatataatctgtcttcttttgttacaacaacttctgatcagtttaattgcattgtacttctatgtgataacaaaataaagttagtacaatatacagttcatatcatctaattctagtaaaacttgttgctaactttgctaaagatggagatggtggcaaggaattcccatctcctggcataagctaaaggctttgatttgattaggataagggctacatttgatacaatcttgtttcctgatcttgtttggaattaatttatataactttttcactgaatatcatttttattatttcagcctgatgatgcagagaatgaacctacttcaccagttgatgtacgaggctcatcgacagataacaaaaatcaccaatcaaatgcttaatgttttggttgtggactacttttgctttctaggaatttaatttttagtggttgtctagacttgtgtttatatcgcttttagttagtacttaatgttttcgttgtagactacttttgctttctaggaatttaaatttgtaatggatgtctagacttgtgatcattttacttcagctaatgtttaatgtgttttgttgctatcaagacttgtgtttatattgctttaggaattatattgctttgtttctctcttgaatatagggaataaaatcaccaagagttccctcgccaggaaataatgttgtcatatctaaaagaacaatatcactaacatatctaacaattacaccagttgatactgcagctccaagaacaacagtttcatcaagtgtgattcgtgtgccacaatcacaataagcattatgcaaagcatggttgaacaaataaggtaatggtgattgaactctaaaagatggagttaatataagctcttggctgaagaatttcagttcagaagccaaacaaaaagcattgtactccaactagccttgtcccagtgacaaaaggcaagttgaagttccctttgaccatgaatggaataattcctagcaccaggttcactacagaaccttttaataccatatggttcagcagcccctgcaagaacttgttgtagtaaggcattctcatcttcccttagatcaattttcttgttttcatgttcaacagtggtatcattcacattttcaatcactgctatatcctcagaagttaactgcttttccctattttcttgctttagtcttcccattttcctcacattttcagtacttcaatttctgacttttgctattatggataataggtagagtgaagggatcgaacccccttcatcgaaaaataatacaatattgtcttctttttgttatatgtgcactattatgaaaaaataatcaaaatgtagttgtgaaggaggttcaaaattgctttaggccttaggttcaaattccaactatgacgttgtagatttttttgtattccgttgtataaatttatggttctgctattgttcacaagcttgaactatagtgaaattctaataatgaaatggttatgaagatattcaaagaagaacaatagtgttggataaagctggtacaagtgaagtatagggagctggcattcttgtgcacaatctgtaagttccatgtatggtgtaggatctgcaactgcataaggaatcattggcctggtttctcaaaaacagtaaaaataaaaagtggtaaattgggaaaagattaaaatttggaatgacttggtctgcgaacacccctctaagaagcagaatcctgagatctttgatcttactgcaagtcactattttacaatgtaaatctagttacaaatggagtttaagccccaaacaaagttgttctgattgatatcaatagtgttgcaaaactgttgaaaggagtttattgtttgggagcctgctgggaaaggaggattttttccggcaggtcatgctataagaaattgttagtgggaaatttagtgttccagaccattgaagctcatacatggcccaaaagctccatacaatgtgtttggcttttgctggattacagttttgctactgcaacctcagttttattctcttgaggtcaataagtcctgaatacgaagaattccttattccttttcttgtgtagatcttgatggtgcttgctcaatgtggtacttggagtttcatagttatatgtacacatttgcaaagaactatgatcttttgtattagcttatacctgatgttgggtactgattcttttacctcttgtgcgtactctatttttggaagaatggtctttggcttcatataccatctttttatgatttatgagttgtatccttgagtaacattgagttttaatgtgttgattgatgagaatgtataaaaacaaagtagttattgctagttttcctgggagttgaccatttttactcaaatgcatatctaatttaggacttccaaactctgaaatgtttgtccctttggtgtcacattgaattggcaaaagcagtttgctaaaaattttgtgcatagtttcttcatgttagatattcagttttatataaaacttttgcagggtcctgttggtactggcaaaaccactagtatattagctcttggtcatgagcttttgggaccaaactataaagaggccgttttggagctaaatgcatcagatgataggtatattgagcgtttgattcaaagtatatgtgccctggtccgatttgcaagattatctgacctagagatcctcggacgcctatggctgtggttgcagcagaaaaggtactggcaatcttaatactcgacacacatgctattttcttctagtgttcccctgctgctccgaaatggtttcttttgatccttgtgttaaatcaatatttttgtctgtacagtgagtcaggtagcatgttatataccttaatctgttgccgcacaatgaacctcccagtttctctgtaaatttcatgcctttctttgctagttaatttggttatgagctaaccgagattatgagctaacgggtaggaactttaattttctgtatctttcagcctcacaaggcgttgtgaaagtttcatctaatcacttcaatatgtagtccattttgtttttaccaaatgttatatgagctttccatctgctctcactgttgttttctccctgttgtgttacatgagaaattatcactaatgcttttgtgttcaaaccgtgtacctaacatgcgtgtaatgacccgacttgtcgttttaaaaatttaactccccgttcaacgacttaaggtctcgagcagcttcgtaatatgtattatgactcgcgtgtatggtctagtttagttttcggaagattcagaatttaatttaaagaaaaattctcatttgaagcttaaatagaaagagttgaccggagagttgacttttgagcaaacaaccccggaatggagatttgatgatgtcatagctttgtatggtaatttcggacttaggcgtatgttcagacttagatttggaagtccataggacaattcgacacattttggcgaaagttggaaaataggatattttggaaaaaattcgaccgaaggttgaaattttgataacgaggtcggatttcgattccggaaattggaacagctccattacatcatttatgattcgtgtgcaaaatttgaagtcattccggtttgattcgatatgtttcgaagaaaaatatagaagttggaagatttgaaactcataattcaattcatggcgcgattcaaaattttagtgttgtttaacgtggtttaaggccttgactaagttcgtatggtattttgggacatgttggtatatttggttaaagtcccgagggtctcgggtgaatttcgaaaggctaacggatttgattttggacatttgaagatgctggaaattttgggcagctgatgtaatggcttctgcgatgttgtggatgcagcaacgacaatgcgtgtgttatctgaactttctaggttaaccgcggtgttaaatctctagcagatgtatccatggatatcatcagattgattcagacactcaatatgtcaacaactgcatttagggatggtgttaaattgacacttgaacaatttgattctatccagattgcactgatgtgacttctcgatcacctataggcctagctgctggactaacctgcgttgtagttgctgttgcaggagtagtggttgtcacaatttgcagcggcccagtttttgttgttgcttttgttgttcgagcaccagtaggattagcattagaggtactgggattaatttcttgctgctgcgttgtaggtgttccagctactgcattttgacaagtagtacttgacagtgctgttgttttctcctgagtagtaaataatgccgctacaagttcctgctgctgctgtccagtttctgattttgatgttgcagcatcgtgcatttttccactgtgctgttgttgttcaatagctgcttgtgtttctgttgtttgttcctccacagatgtttcagctggtattaatgcattattctgctgctgttgtccagttcttgctgcatttttcagtagagaaactgctgtgctttgaccaaactgttgctttccagcttgctgctgctgtccagttcttccacgtttttgctgtcccttttaaggcacaaattctggtgcctttgcgttaagattgctgctggaaattgccattgtaggactgcctttttttggtatagatggtgagccaactgagcgtaaaccttcctcttcactctcttgatcatcctcctcactcgaatactcaccatatgcatcaccataatcttcctcatcatcatactcgcgttggtttgtccatagcttagatttgattgccatctccctcaaatttgtctttataatttccttgttatttccagatgacaacaccaactcacctccatattcaccacaagactccaacgattgtgatggtacctcatgaactgaggtgttcaatgggaccattggttgtttaaccatgttagtatgcatcatcattgcattttgggcgtcttattgcatatggcgtacatattgttaacttatcaattaaagttactatgagacaaaattcaactttaacgtcttatctttcaaacgattaaaagaacataatattttttttaaatattatcaaatttcacgtactctctaaaaattaacaaccaataaactccataaataatgtaattcgaaatattagtcctcatgagtaaatataaaattgctttcaaataggaactattagacgaacctcgaacgaagagcgtttggcgcatttggggtgcacaatgctcggccactgaggtgtaagtctcatagaactaagcatcacacgtgaggcgcagagcatttgatagtgtcccgctccgaacgagacacgaggtgagtcccaagaaagcattttaaaacacaattccgtgtattttgacgattttatcatatgctacaaacttgcaagtatatatatccttttatttgaattatgaaacacataattttcacaaaacaaggaaatcaacatgatgtgcccgcatattcatatgacacgatttttcctatgttgatctagctaatttaattattttcaagagcttattccctttttaatttgcattttataacttaaatatattatttaatatttttagttgatttcttaattgtatgcttaattttatatagatacatccgtaaaagtgtatcctaaaattagtaagaactaaaataaataataaaattagtgccacaaagtcattatttcttaactctaaggcctaaacgttatttttccactcagaattaaaatctttttggtttcacaaattttaaatcttttttaccttctttaaagcacttatttatcataactcacaagagtagaaagttctctatattaatataatattattaattctcataaattattaaagctttaaataattggaagcactaacggtttattttaagcaaggaaagcggcgtctatcctccataagcagtaacaggggaaaatattgaaatttcttctgattaggttttccttcgtttgtagttctgaccctctttttttctactacttgttatccttcgctatgtgaacgaacagatataaacatagtcgtttgtgggaattgttcattggttctttctgtcctctgtcactttctggaattaagtttgtttgaaagagcatttgaaattcttggagtagattggaaggatagccaaatctgaaggtacccgtggactggaggattgcttctggaggtatattctaaaagggttcatgttaatttatttatcatttttcaatggataaataatggattggaaagccacggaatacaaaggaatattgacttggtttggataaatttcttgattttgcgcttaagaatgcggttgtggaagatacaattagatgcccatgtcctaaatgtggctttggcaagtggcaaactagagagatagtgcaggatcatttgatttgcaagccattccccgaaaattatgttatttggaatcttcacggtgagaaacaagtagtagagccttctggagatagagatgttatgcaagagatggttcacccagaaaatccaatagaaacaatgcttaatgatgcatttgggcactataggcaccaagcggctgatgtaggaatatctcaaccattggactcaaatgaaatatcaaatgaggggcatagggaggattctggtgacttttatgattttctcaaagatggaagtgaaacgctgtatgaaggcagcaagttcacaaagctagagtttttaataaaattgtatcatataaaggtctattgtggattaagtgacaaggcaatgactatgatactagatttgttgagagatgcatttgaagatgcaaagttacctccttccttttatgaggccaaaaaaaccattagcaaacttggccttgactacatcaagatacctgcatgtccaaataattgtatgttatactgggaaggtgactcagaattggaagcatgtaagcattgtggtacatctaaatggaatcctaacaagaataaaaagcaagctacaaaggttctacgttattttccattaaaaccaaggttacaaagattatttatgtgttgtaagactgttgagcatatgagatggcatgcttcaagcagtaacgaggatgggatgatgaggcatccaagggatggtgaggcatggaagacatttgatcggactcattttggatttgcttcggatcctcgaaatgttcgcttaggccttgctactgatggtttcagtccttttggaacaatgagtactacctatagtaattggccaatcttcttgattccgtacaatcttcctccttggatgtgtatgaagcacacctccttcatcttatcaatgatcattccaggcaagcaaatgccttgaaataatatagatgtgtacttacaacccctcgtgaaggaattatgtgagttatggaatgatggtattgaaacgtttgactcatcattgaatgaaaattttagaatgcatgcagctcttatgtggacaatcagtgactttcctggattaggtatcctatctggatggaacacacatactggttttgcttgtccaacttgtaactttgacacagaaccttgtcgtcttcgtcatagtaaaaagtggtgttttatgggtcatcgacgttttctgagaagaaatcatcggtttttgttgaatcgagtacgctttaatggaagtacagaggagcggaatccaccattgaaattatcagggtcggacattttgagacaaattgaagaaaggagaggagcagtgttgaatgttagcgggaaaagatctagaagagcaactaaacaatggaacaagagaagtatattctttgaacttccttattggaaatctaacttgttacgtcataatctagactttatgcatatcgaaaagaatatatgtgacaatatcatatatatatacgttgctccatgataaatcaaaatcaaaagataatatttatgcccgaaaggatctaaaagaaatgggcataaggcgtgatctttggccggattatagtggaaaatatcatcttgctgtgttttcacttgtgactgataaaaaaaagaagttggacaccaaaaagttgttccttacaactttgaagaatattaaagtaccagatggctactcgagtaacatttccaaatgtgttgatttggtacaaaaaaagatttttggattgaaaagtcatgattgccatattattttagagcaattgctaccattggcgatccgcaatgtgttgccagaccatgtagttacagttttggtggacttttgctcattttttcgtgccctttctagcaaaaccttgaatattttggatcttgataagctccaagagcgcattaaaagcatacttttccacatagagatactatttcctccggcattctttacagtaatggttcatttgtctgtccatctagcagaagaagcaaaactgggaggtccagtgcattaccgaaacatgtatcctattgagaggtaaaccattaacatttctaattttaatatacttgtattctggtaattttaaatagtttgtacacttatttcctataatttttgtagggaattaggccattttaagtcatttgtacgaaataaagcacaaccagagggttctatagttgagggttacttagctgaagagtctcttaccttttgttctcggtatattgaggatattgagacaagattcaatagacctaggcgtgttcgtgatgacccaaatgtcactgagccttctggaaggtcctctatcttccctcaattaggtaaacctgcatcagcttcggttacattccctttaactcagatgcagaaactacaagctcatcgatatgtgcttctgaactgtgcaattgtcacgctatttgtggagtgagtaactcatacgaactttatattctttatcattgtaatgtttgaagtagtctagtcatgttctttaacgttaatataattatttcatatagcgaatttagacagtacataagtaggagttcaagaagaagaccatcgcctactgagatagagaggagagttaataaaaagtttgttgattggttccaaaagcgggtgagtaagttatcattagttattatttacatttgatttgaatgacactaagacaattttattttgatttagattatgaatccagacacaatagatacaatgtctattgatctaaagtttcttgtacgaggtccatcggcacatgcaagaagttttactgcatataacatcaatgggtccaaatttcgaactttggctcgagaagaaggtctacaaacacagaatagtggagttttcttaacctctaaaacatcatgtattgcaagtagtgtagacggaaatttaaggcaagcaaagttaccatattatgggaagttagaagatattattgagattaattataatggtcggttcaaggtggttcttttcaaatgtagatgggctgatactgctcgagatagagggtataaaaaggatcgttggaacttaaattgtgttaattttgataaattgattcataaaggtgaacgtaaagaacatgagccttatatcgaagcatctcaagcacaacaagtgtactatgtggatgatgttgtcaataaagggtggagtgttgctgtgcatctaaagtcaagagatctgtatgatatgggagaagaagtagtggaagatgatgtatatgagaatgaaccatagcaagagcaagaactcgaacagttctttagtgatggtgatgagcatgtacaactagctacagatcatataattgatgatgtagtagaggcaaatgttgatactaacttagcatcagatacatgcatgtttgaatagattttttttttaatatgttactttatatgaaggtaacggtactgcataactaagtaatatttgtttcatttatttggtgtataggcatgtttagaaatggtatccatatttggtttgaaggcatatttagaaatgatattcatatttgcttcacccttttttatttgattcacctctttttaatctgttgtgatcatgatatggcacctcctaccactgcaatgttacttggcactacggctgctgcaggtacttgtttcatcattaaggttgcagctgatattatgttgataactgccacatttttctttgacattgtgtggaagtccatatcaaaatgcatggttacgttttggtaagctttttggttctttaacttcgaccgataatgtattgagtcatggagtagattggctgttttgtttttatttattgtttacttggtgaagtaattccgaaactgagggtttttggtttcttgttgtgtttggtgtttgtttattttgtatgtcttgtcttatgttctaagaaggcaatagggatatttccctcactgtgctgacaatggatgtgagcagacttctgtagcttttatgtataaggaagaccaaaacaggtcttgttcatcttcatccaggaattgcctgtttggtagttacaaatattttctgaatacactgtaaaattctactccttatattgttttacttatatttcttaatacagaattcatttattctttcaaaatcattttaatagggaaatgcaaatactcactctcgtatcgtttaaagtatacgtcatgctgcaattttcaactgtatcttcgttgcctctatttgggtcagcgcaaggctactaacaatgaggcattaccaaacatgaagaccgaattcatggctttatgggatggttttaccacagatcgtaggttcattccttaatgagataatttccttattagtagctttcattcaccaatataatcaccactcatttgctacaaaattttctcagcaagttatgcaatttgagatggtcatgtctcttagctagttaatgtggtctagcgagaaagttttgtgactttatttactgagataatgcttatctagataatgcccaggttatggtacttgctgctactaatcggccatctaaacttgatgaagcaattcttcgacgccttcctcaggcctttgagatcggtatgcctgactacaaagagagagctgagatttgaaggttattctgaggggcgagaaggtacaagataacattgactatgaccgcattgctggattgtgtgatggatacacttgtttagatcttcttgagctctgtaaaaaagctgcctacttccacatccgggacctgcttgatgatgagaagagtggaaagcaatctgctgttaagttcctgggaccaacctaccaattcctgaaatgtttcctaacatgtttcctttagcatcgggccaggtactatcagcactcccttttcagttgtgtggattcaatgcttttatcaagattctcattttcttgttccttcttggtgtggtagtttggagttcttcctgttatgccgatccaggcaatgacacagcaggttggtaatgtgtcagtaatttccttttcaagatcacggtgcttatgagttcctctttttaacctaaaatgtttcctaacttgttttgttatcgggctactaggcatgctcggcgagttaatgttggtggacttccggctcatgcaaatgaacaggtattagaccaccttccaccaatctcaaggaatagttggtctttatgaaatttccatataatgtttattagttaaggaattaacttggtcttttttttgaatactcttatcttagagaacgggttcctgcaccaaaagatgaaacctcttcccaagttttaggcatgcccacattgatttaaataggatctagaactcctgcagtacttctcaggttttcaatttcttgacacagttcctcctcctccttatgtacgttatcttgacttgaccatattcttatcttgctttttgacatcttcctgtttctgttacttagagtgcgactcctgcagtacttctcaggtttctgcgcgagcatcgatcagaatagatagacaacgatattgattcccacgcagctgcaactgttaaagttggtccttgcagcctacctagggcccgagtctataattttttgtggtcaagtgttatttccactggcacacaccgctgaacatgaagaggcaagtgttctggatcctatttaaatcaatgtgggcatgcctaaaactgttcctttttgtcttctttggataatacaggatggattccaatctgttaccttttcaaaaaaaaatatgggatggattcctcatcattaatattgatcacaatctcttttatgctcagtagttgctggaggtcatcaagttggaaggagtttgtcattctccagaaagatgttataatgccaagagatatgttcctactgcaagtaagttctatttctgcacatggattttgttcttttgtagagaatcttaactggatctaacaaagctcgtacctctatataagagacagaattgtacaagattgtgaagcttaacttaatggtttgagaaacttcagttgttactctgacaatgaaatgccttgggaagcttagctgcctaagaatcgtagtggttctctagcttccttctgttttgcacccctgcctctgttttttttgggttatatatgagtgtcttatctctctcatgtaggttcaaggttaaataagccttttgtgtaatggagcactgagctttggtctgacacgttatgcgatgtcaaagtttgaattattggcagatgagcttttgatgagtgattctgtcattaaggtaagtggtagaatctccttgcagatacagattttgttgttttataacggttgtagtgtctccttaaccttaagccctttcttttggtgatatatagaagtgttcatgcaatattccaattggaaagtctttttcacatctgtttttcatttacaattgtcttcataaactctaactgttagactctagcttgtgcctctactcttcttttcttctacttgaatgatgttatagctgtcctttggagcgtcaattttgatgcattacttgcattgaccactggaaacatcaatacatgcaatacatattgcatgtgcttgctaaagctactacacggaagttgaaaaacagcttagctaagcgtaaggtctccctgctgtcgtgttataattgtattctaataacagcttgactaaccattaaccgtaatgtctcctcatagtcttgcattttctgacactgtcatataaaagcataaaataattttaaacgaagggaaaatttccagactgaagcaggtgatgctagctttgttaccatcttttcatgctgctgtatctctcctccttgtactaaaataaggtgcctctccttgtagtgtagatgcctgaggctgtcaagtagctcgctgaatataaattgaaaattatcttgagttggttattttgagaactttctatgtttagttttatatgatttagttatctatgtcaacatgatttaggaccccaccttcggttatttaacctaagatttttgctataatcattttgcttactgaaaaaaggataataataaaagggggagggggtggggtgactcttagatatttgtgcaatgtgcggcaccaatttgaaactgtggtccagcacctttttcttttatttcaaaaagatttgcatgtctagaatcaaaaggagagtttatagtttctctttccttcagtatttggggtcataagcacccaaatggcttgggatcctctgaatgttgttccttatttgattgtagattaatgtttctatcatcattaaggtcttaaggaagaattgtcaaaattattcattaggatgaaagagaagttggagttttattcactgacaatgtctggtctatctcgctgctgctgttcccttcgtgttgtatgctcatgtacctatttttttgataaggtagggtaaaaatacctactacagccagtctcagttttgcttctatggttttatgcgttcttttggttcttgggcataaatttcttaactgtgcttctagaagcatggttatattgcagctcttatactcattgttcccaagcgctatgtcttgtattagcgtatttctgaagctttggcagtgaatgttatctgacttgcttttttcaggtttttggtgtgacgacccaatgaggtcatcaccataaatgctccttattccatgcttcagaggccttgaaaacctcttgagaggttgcctcgatttgcgtgcacagttcgggcgcaaagccggaaagattttctatattgaaaaatgaattcttggcttaaaatgatgaattttgagtataatattgatatagttgactccggtcaacattttgggtaaacgggctcggacccgtgtcggattaatttctgtagatccgtcatgaaatttgggactcgtgcatatgcccggaatcgaattccgaggtcccaagcccaagatatgggaatttttgtaaaactagcttttgaaattttcttaagtatttgaaaatgattaattgattgttgaatgtcgtatcgggctcgtattttggttctgacgcccggtacaggtcttatatggcgtttaagcgctacctgtaaaatttggttgaatttggacgtcgtttgacgtgtttcggaccctaagagcaaatttgaaagtttgaagtttaaagtttggaaattaaggattttgagggtcgattctatgtttttgatgttattttagcgatttgatcgcgcgagcaagttcgtaggatgattttgagtcaatgtgcatatttggtttagagccccgagggctcgggtgagtttcggataggtgacggagggtgtttggccttaagaagtgcagcagatttgctgctgctgtcaggtactggtttccttctatgcgatcgcataggcttgatgcgatcgcatagagtaaaaatgttaggatcagagttccttctatgcgatcgcataggcttgctgcgatcgcatagtgtaaatgtgaaggcccagaagttccttctatgcgatcgcagtccttctatgcgatcgcatagagcaaatgcccagcccctctgtttccttctatgcgaacgcaatacccttctgcgttcgcgtagcacaagccagaccccctcaaccttccttctatgcgatcgcaatccctctatgcgatcgcatagagtatttcgcccagtgatttttataaaattccagaacactatatctcggccatttcacccatttttcactcaaactcatttccaaacatctccattaacaaaaatccaagcttccaaccttcacaactcattgagtaagtttactctaacttgtttcctttattatttcttccattatcattgagtttcctctctttaattcatgtgtttaagctagaaatcaaagtttttggggttagctagggcttatgagattttgggtatttcaacctcattttgaggtcgaaattagaaactaattatatatttgtactcgtgagtgaatgggttgtcggaaaatggttcgaacctcgagttttggctacgtgggcccggggtcatttttcactattcatggcagaatagtatgcattgcgtttttggcaatttgggttgttttgttgagtagttattgatgatattgaaccccttatgtatagatataattgaattggaggcgaattcttaaggaaaggcattgcgagaggcttgaattgctagatttcggcacttgaggtaagtgtttgttctaactctagttcgagggattaggactaagaaattatttgctatgtgttatatgggtcggtgtataggtttggtgacggttacctatgcacccgagtcaaagcacgaccgtgggtctttacttgagattgttgaaagctatgatatggactctagctattgagatgattcttataagtaaattgttggatatgaaattcttaaatggtataattgaatagttaaagcaaaatgctacgcctagaaaatgttggaatactatgtgaatattgtgttctttgagatggaacttattatattgaaatgggatcgtgtggcacgccgtccacttattatattaaaatgggatcgtgtggcacgccgtccacttattatattgaaatgggatcgtgtggcacgccgtccacttattatattgaaatgggatcgtgtggcacgccgtccacttgtgatattactatgggatcgtgtggcacgccgtccacttgttattatttattatgggatcgtgtggcacgccgtccactttgtgcttattgtttcactttgctcattgttttattttgagtaatcttacatattaactgcttagcttattatgtctatgctttagaattgtataccccttacaacatgctccctcccatatttctctattccgtacatttattatcttgcacaggtttatgcggtagttctggtttagcctcgtcactacctcgtgagccggggttaggccaggcacttaccagcacatggggtcggattgtgctgatactacacttctgtgcccttttgtgcacagatccgggagcagcttttggagcatatcagcagtagacgggaagctagctttcagatctgagactgcgaggtagtccaccggcgtccgtggaccatccagtcttatctactagtttcagtttgtttatcagttcagacagactttattatgtatttcatttcagacctttatttgtagtaactcttagaagtccgaatgctgtgacactgttcttgggtagggaattgtatcagatttcttccgcgttttgtatttatgaaagtatttaaagtctttcgctaatttttatgccttttaattattaattgtaaattgtaaattgataagagtatgttggtttggattgcctagctccgacagtaggcgccatcacgatacccgttggtgggaaaattcgggtcgtgacaagttggtatcagagcactaggttacttgagtcttacagcttacggacaaactcggtagagtctgagggagcggtacggagacgtctgtacttgttccccagaagctacagagttaggaaaatctcactttattcattcttgtcgtgcgattctatttctcaatattgattgtctctctactctgtttcttcgcagatggcgagaactcgagcttcctcttcttctgattagcaagccgatgccccagcagcagttccagctaggggcagaggacgaggccgcgctagaggccgtggcaggggcagagctcagccccgagcggcagcaccagaggtagagccccagattgaggttgaggaggctccagcctcagctgtgcctatggtcattccgggtcttcaggaggccctagctcagattatgtcggcttgttctggcttagcccaggtggtctcagccaccgctgcagcagccacctcacatattgggggaggtaatcagacccccgttgctcgcacaccagagctagtggcacagggattacagactccagaggcaccaccagtacagcagggtgccccagcccctatagttgtgccagtgcagacagttattgcgggccagactagtgatggtgcggcgatgtccgcggattccttgtggaggcttgaccgcttttccagattatttactcttaccttcagtggtgcaccttctgaggatgctcagaactatctatatacttgtcatgagactttgaggactatgggtattgtggatactaatggagttgattttgccacttttcgcctgactggatccgccaagacttggtggagggatttctgcctatctaggccagtagggtctccagctttgacatgggatcagttcgcggagctatttctggggaagtttctccccgttactcagagagaggctcttcgtcgccagttcgagcatctacagcagggatatatgacagtcacgcagtatgagacgcggtttgtggacctggctcgtcatgccttagtgttacttcctacagagggcgagagggtcaggagatttgtggatggtttgcatccggatatccgagtgcagatggctatgagcgccgatggtggtctatcttttcaggaggcggcgaatggcgcccgccgaattgagttggcattgtctttgggaggcggtactgggtcagataagaggccccgtcgttctggtcagttcagtggtacctcgtctagaggtagagattcacatgctaggggccagcccccgagaccatttcagtcagctctccagacttctcagggtgccccaggtgggcgtggttcacagactcagttctccgatcagcagctgtacagttctccttccgcacccatcagtgcaactccagtgagatatgctcagcagaccagagcttgttacacatgtggtgatacgaggcacatagccaagtattcccccagagcttccagcagttcaccgcagtagggaccccgtcccatgattcaggcaccacctgccccacagcctgcccagccagctagaggcaggggcagaggtcatagaggtggaggcagaggccttagaggtggagatcagccagttcgaggcagagatcaggtagcggcggaccctcctagggatgctattcagggaggtggggcccagccccgttgttatgctttaccagctagacttgaggcggaggcatctgatgcagtgatcacaggtactattttggtctgtgatagagatgcttcagtattatttgatcctggatccacatattcctatgtgtcgtcatatttcacaccttatttggctacacctagtgaggccttgggtattcctgtccatgtagctactccagtgggggattctatagtggtggatcgggttcatcgttcctgtattgtggtattcaggggtcttgagacccgtgttgatttattattgctggatatggtggattttgacgttattcttgggatggattggttatctccttatcatgcgatcttggattgtcatgccaagaccgtgaccttagcattgccggatatgccccgactagagtggagagggacccctggtcataccactcgcagtgttatttcttatgtgaaggctcgacgcatggtcgagaaggggtgtgtagcttatttggcttatgttcgcgactccagcactgaggtcccgtctattgattctgtccccattgttcgggagtttcccgaggtgttcccttctgatttgccgggcatgccgcccgacagggacatcaatttctgtattgatttggtgccgggcactcagcccatttccattcctccttatcgcatggcaccgccagagttgaaagaattgaaagatcagctccaggaatttgcttgagaggggtttcattagacccagtgtgtcacctgctgacagttcaaacaccgagcaacataagcaactatatccctcttcatcctacgccaccaataatgttgtctcaagtcctgatacatcttcgcggcgcccgggtgaatagaataccgagaactgtgggcctccgctaagatcaaatcacgaataccatcaacattgggcacacaaactcgcccctgcaatctcaatacaccatcgtctcccaaagtcacctccttcgcacctcctcgctgaaccgtgtctctcaggacacataaatggggatcatgaaactgaagctctcgaatacgctcaaatagagaagagcgggcgaccgtacaagccaaaatcctgctgggttccgaaacatccaatctaacaaaacgattggccaaggcctgaacatctatggcaagcgatctctggccaactggaataaaagcaagactacccatactagctgactttctgctcaatgcatcggccaccacattggccttacccggatgatatagaatagtaacatcataatcctttaacaactctaaccatctcctctgcctcatattcaactccttctgcttgaacaagtactggaggctcttgtgatccgtgtagacctcacatgtcacaccatataaataatgcctccaaatcttcaaggcatgaacaatagctgctaactcgagatcatggactggataattcttctcgtggatcttcaactgcctctaagcataagctataaccttaccattctgcatcaaaactgcaccaagcccaatacgagaagcatcacaatagaccgtgtacggtcccgaacccgtaggcaataccaacaccggtgccgtggtcaatgctgccttgagcctctgaaagctcgcctcacactcgtctgaccatctgaataaggcacccttctgggtcaatctggtcataggggatgcaatggatgaaaacccctctacgaaccgtctgtaatagccagctaaacccaggaagctccgaatatctgtagctgaagctggtcgaggccagttcttgactgcctctatcttcttcgggtctacctgaatgccctctgaagaaaccacatgacccaagaatgctaatgaactcaaccagaactcgcacttagaaaacttggcatataactgactatccctcagagtctgaagaaccactctgaggtgctgctcgtgttcctcctggctgcgggagtataccagaatatcatcaatgaagactatcacgaataagtctaagaaaggcctgaacactctgttcattaactccataaatgcagctggggcattagtcagcccaaatgacataaccaggaactcgtagtggccatagcgagtacgaaaagctgtcttagggacatcagacgccctaatcctcaactggtgataacccgatctcaaatcaatcttggaaaacacactcgcgccctgaagctgatcaaatagatcatcgatcctcggcagtggatacttgtttttgattgttaccttgttcagctgccggtaatcaatacacatcctcatggaaccatccttcttcttcacgaacagaactggagcgccccaaggtgacacactgggtctaatgaaacccctctcaagcaattcctggagctgatctttcaattctttcaactctggcggtgccatgcgataaggaggaatggaaatgggctgagtgcccggcaccaaatcaatacagaaatcgatgtccctgtcgggcggcatgcccggcaaatcagaagggaacacctcgggaaactcccgaacaatggggacagaatcaatagacgggacctcagtgctggagtcgcgaacataagccaaataagctagacaccccttctcgaccatgcgtcgagccttcacataagaaataacactgcgagtggtatgaccaggggtccctctccactctagtcggggcatatccggcaatgctaaggtcacggtcttggcatgacaatccaagatcgcatgataaggagataaccaatccatcccaagaataacgtcaaaatccaccatatccagcaataataaatcaacacgggtctcaagacccctgaataccacaatacaggaacgatgaacccgatccaccactataaaatcccccactggagtagctacatggataggaatacccaaggcctcactaggcgtagccaaataaggtgtgaaatatgacgacacataggaatatgtggatccgggatcaaataatactgaagcatctctatcacagaccaaaatagtacctgtgatcactacatcagatgcctccgcctcaagtctagctggtaaagcataacaacggggctgggccccacctccctgaatagcatccctaggagggtccgccgctacctgatctctgcctcgaactggttgatctccacctctaaggcctctgcctccacctctatgacctctgcccctacctctagctggctgggcaggctgtggggcaggtggtgcctgaatcatgggacggggtccctgctgcggtgaactgctggaagctctagggcaatacttggctatgtgcctcgtatcaccacatgtgtaacaagctctggtctgctgagcatatctcactggagttgcaatgatgggtgcggaaggagaactgtacagctgctgatcggagaactgagtctgtgaaccacgcccacctggggcaccctgagaagtctggagagctgactgaaatggtctcgggggctggcccctagcatgtgaatctctacctctagacgaggtaccactgaactgaccagaacgacggggcctcttatctgacccagtaccgcctcccaaagacaatgccaactcaattcggcgggcgccattcgccgcctcctgaaaagatagaccaccatcggtgctcatagccatatcagccagttcgaggcagagatcaggtagcggcgaaccctcctaggaatgttattcagggaggtggggcccagccccgttgttatgctttgccagccagacttgaggcggaggcatctgatgcagtgatcacgagtactattttggtctgtgatagagatgcttcagtattatttgatcctggatccacatattcctatgtgtcgtcatatttcacaccttatttggctacgcctagtgaggccttgggtattcctatccatgtagctactccagtgggggattctatagtggtggatcgggttcatcgttcctgtattgtggtattcaggggtcttgagacccgtgttgatttattattgctggatatggtggattttgacgttattcttgggatggattggttatctccttatcatgcgatcttggattgtcatgccaagactgtgaccttagcattgccggatatgccccgactagagtggagagggacccctggtcataccactcgcagtgttatttcttatgtgaaggctcgacgcatggtcgagaaggggtgtctagcttatttggcttatgttcgcgactccagcactgaggtcccgtctattgattctgtccccattgttcgggagtttcccgaggtgttcccttctgatttgccggtcatgtcgcccgacagggacatcgatttctgtattgatttggtgccgggcactcagcccatttccattcctccttatcacatggcaccgccagagttgaaagaattgaaagatcagctccgggaattgcttgagaggggtttcattagacccagtgtgtcgccttggggtgctccagttctgttcgtgaagaagaaggatggttccatgaggacgtgtattgattaccggcagctgaacaaggtaacaatcaaaaacaagtatccactaccgaggatcgatgatctatttgatcagcttcagggcgcgagtgtgttttccaagattgatttgagatcgggttatcaccagttgaggattagggcgtctgatgtccctaagacagcttttcgtactcgctatggccactacgagttcctggttatgtcatttgggctgactaatgccccagctgcatttatggagttaatgaacagagtgttcaggcctttcttagacttattcgtgatagtcttcattgatgatattctggtatactcccgcagccaggaggaacacgagcagcacctcagagtggttcttcagactctgagggatagtcagttatatgccaagttttctaagtgcgagttctggttgagttcagtagcattcttgggtcatgtggtttcttcagagggcattcaggtagacccgaagaagatagaggcagtcaagaactggcctcgaccagcttcagctacagatattcggagcttcctgggtttagctggctattacagacggttcgtagaggggttttcatccattgcatcccctatgaccagattgacccagaagggtgccttattcagatggtcagacgagtgtgaggcgagctttcagaggctcaaggcaacattgaccacggcaccggtgttggtattgcctacgggttcgggaccgtacacggtctattgtgatgcttctcgtattgggcttggtgcagttttgatgcagaatggtaaggttatagcttatgcttagaggcagttgaagatccacgagaagaattatccagtccatgatctcgagttagcagctattgttcatgccttgaagatttggaggcattatttatatggtgtgacatgtgaggtctacacggatcacaagagcctccagtacttgttcaagcagaaggagttgaatatgaggcagaggagatggttagagttgttaaaggattatgatgttactattctatatcatccgggtaaggccaatgtggtggccgatgcattgagcagaaagtcagctagtatgggtagtcttgcttttattccagttggccagagatcgcttgccatagatgttcaggccttggccaatcgttttgttagattggatgtttcggaacccagcagggttttggcttgtacggtcgcccgctcttctctatttgagcgtattcgagagcttcagtttcatgatccccatttatgtgtcctgagagacacggttcagcgaggaggtgcgaaggaggtgactttgggagacgatggtgtattgagattgcaggggcgagtttgtgtgcccaatgttaatggtattcgtgatttgatcttagcggaggcccacagttctcggtattctattcacccgggcgccgcgaagatgtatcaggacttgagacagcattattggtggcgtaggatgaagagggatatagtttcttatgttgctcggtgtttgaactgtcagcaggtgaagtacgagcatcagagacctggtggtctattccagaggattgagcttcccgagtggaagtgggagaggattactatggactttgttactggcctcccgatgactcggaggcagtgtgattcagtttgggttattgtggataggctgactaagtcagcacacttcattccagttgctactacctattcgtcccagaggctagctgagatttacatcagggagatagttcgtcttcatggagtgcccgtatctatcatttcggatcgaggtccgcagtttacttcccgtttctggatagccttgcatggagagttaggtactcgtgtccagatgagcacagcatttcatccacagacggacggacagtctgagcggacgattcagattctggaggatatgcttcgagcctgtgtcattgactttggaggctcgtgggaccagtttctgtccttagcagagttcgcctacaacaacaactatcagtccagcattcagatggttccttatgaggcgttgtatggtaggcggtgtaggtcctcagtcggatggtttgagccgggagaggctgggtaattgggtgttgacatggttcaggaggccttggataaggtcaagatcattcaggacagacttcgcacagctcagtctagacagaagagttatgcagaccgcaaggtcagagatgtagctttcatgattggagagcgagtattgctccgtgtgtcgcctatgaagggcgtgatgagatttgggaagaaggtcaagctcagccctaggttcattggcccgtttgagattctggagcgagtgggagaggtggcctataggcttgctttgccacctagtttattagctgttcatccagttttccatgtatccatgctccggaagtatcacggtgatccatcgcatgtcttagatttcaactctgtccgattggacaaggatctgtcttatgaggaggagccggtggctattctagaccggcagattcgacggttgaggtcgaaaagttttccttcagtgcgtgttcagtggagaggtcagcctcctgaggcttcgacctgggagtccgagtcagatatgcgaagccgttatccacatctgtttcccgactcaggtacttctttattttgtccgttcgaggacgaacggttgttttagaggtggagattgtgacgacccaatgaggtcatcaccataaatgctccttattccatgcttcagaggccttgaaaacctcttgagaggtttcctcgatttgcgtgcgcagttcgggcgcaaagccggaaagattttctatattgaaaaatgaattcttggcttaaaatgatgaattttgagtataatattgatatagttgactccggtcatcattttgggtaaacgggctcggacccgtgtcggattaatttctatagatccgtcatgaaatttgggactcgtgcatatgcccggaattgaattccgaggtcccaagcccaagatatgggaatttttgtgaaactagcttttgaaattttcttaagtatttaaaaatgattaattgattgttgaatgtcgtatcgggctcgtattttggttctgacccccggtacaggtcttatatggcgtttaagcactacctgtaaaatttggttgaatttggacgtcgtttgacgtgtttcggaccctaagagcaaatttgaaagtttgaagtttaaagtttggaaattaaggattttgagggtcgattctatgtttttgatgttattttagcgatttgatcgcgcgagcaagttcgtaggatgattttgagtcaatgtgcatatttggtttagagccccgagggctcgggtgagtttcggataggtgacggagggtgtttggccttaagaagtgcagcagatttgctgctgctgtcaggtactggtttccttctatgcgatcgcataggcttgatgcgatcgcatagagtaaaaatgttaggatcagagttccttctatgcgatcgcataggcttgctgcgatcgcatagtgtaaatgtgaaggcccagaagttccttctatgcgatcgcagtccttctatgcgatcgcatagagcaaatgcccagcccctctgtttccttctatgcgaacgcaatacccttctgcgtttgcgtagcacaagccagaccccctcaaccttccttctatgcgatcgcaatccctctatgcgatcgcatagagtatttcgcccagtgatttttataaaattccagaacactatatctcggccatttcacccatttttcactcaaactcatttccaaacatctccattaacaaaaatccaagcttccaaccttcacaactcattgagtaagtttactctaacttgtttcctttattatttcttccattatcattgagtttcctctctttaattcatgtgtttaagctagaaatcaaagtttttggggttagctagggcttatgagattttgggtatttcaacctcattttgaggtcgaaattagaaactaattatatatttgtactcgtgagtgaatgggttgtcggaaaatggttcgaacctcgagttttggctacgtgggcccggggtcatttttcactattcatggcagaatagtatgcattgcgtttttggcaatttgggttgttttgttgagtagttattgatgatattgaaccccttatgtatagatataattgaattggaggcgaattcttaaggaaaggcattgcgagaggcttgaattgctagatttcggcacttgaggtaagtgtttgttctaactctagttcgagggattaggactaagaaattatttgctatgtgttatatgggtcggtgtataggtttggtgacggttacctatgcacccgagtcaaagcacgaccgtgggtctttacttgagattgttgaaagctatgatatggactctagctattgagatgattcttataagtaaattgttggatatgaaattcttaaatggtataattgaatagttaaagcaaaatgctacgcctagaaaatgttggaatactatgtgaatattgtgttctttgagatggaacttattatattgaaatgggatcgtgtggcatgccgtccacttattatattgaaatgggatcgtgtggcacgccgtccacttgtgatattactatgggatcgtgtggcacgccgtccacttgttattatttattatgggatcgtgtggcacgccgtccactttgtgcttattgtttcactttgctcattgttttattttgagtaatcttacatattaactgcttagcttattatgtctatgctttagaattgtataccccttacagcatgctccctcccatatttctctattccgtacatttattatcttgcacaggtttatgcggtaggtctggtttagcctcgtcactacctcgttagccggggttaggccaggcacttaccagcacatggggtcggattgtgctgatactacacttctgtgcccttttgtgcacagatccgggagcagcttttggagcatatcagtagtagacgggaagctagctttcagatctgagactgcgaggtagtccaccgacgtccgtggaccatctagtcttatctactagtttcaatttgtttatcagttcagacagactttattatgtatttcatttcagacctttatttgtagtaactcttagaagtccgaatgctgtgacactgttcttgggtagggaattgtatcagatttcttccgcgttttgtatttatgaaagtatttaaagtcttccgctaatttttatgccttttaattattaattgtaaattgtaaattgataagagtatgttggtttggcttgcctagctccgacagtaggcgccatcacgatacccgttggtgggaaaattcgggtcgtgacatttggagcgctacggatgtctgtcaaaatgtttctgatgtggaattcgaggatgataattgatggtggtggagatcaaaatgtttagacaacaattcttgaggctagtaacctaattgttcttaaggtgctctttctttttccgttgcttgtttttcttggttgtcttcgcgtacttgttcattttgagatgtcctctatgtgccatattatgcaggaatcatctcaaattcgttcgaatgcaaatcttggagttcatggccaagggttgttaaatttatctggaccaggagatgctattgaagctcaaagactggtcctgtctttattttacagcgtcaatgtgagcagtgttgtcaaaggctcatttaaggcgcgcttaagccttaaagctcagaaaagctcaaggagggcgcttcgcctcgcttaagctgcgcttcaatataggcaaggtgcgcctcaatgcccatgagttctatcttgaactgagcggtactaaacaacaaatattacagcaaataagtgtattagttgctgaggcaaacattaggagagtatgtatcctttttctcaaattgcatatgtatttttatttgttttctcagttgcgcctttttttactaaagcccacactttagtggggctttgcgcttaaagccccagtagacttggagtgctttttagagcttttcgcttttgacaacactgaatgtgagcagtaatcttgttttgcatccttttgtttccgcttttataggagatgtgcattagattcctaactggtctgtacttgctttcttttgacacttggtttttcctggtcacttgattttttatggtgtttttgacatcagtatatggatttttcaaatcgcgtgtagtaatttctttctccctcgtcatctttgtatgaatatcagatgcaagataatatatttcagtctgcattgggtatctgtgttactgttccaattcttttcactagcaaggtggtaactgagcttagtctttgctcaggttttcacctggtctatgttctgtctcagctcccgaggagcttggtattccagttcctggaccttatacgtagtttgggttgatcattcttttctatatatcatatctatttattttatttcttgtctacttttctcttactgcgtgcagattggaccaggatcggttttgcgtggtccttcacgaaatgcgacaactgatgctgtgtgagttcctaattacttcttgttccttccccctattgtttctttttcaagaagctttcttttattttctaatgggttatttggtgcttgataggaaaccgaagttgaactgtgatagtccaggttgtccttttgaattgctccaccctcctgaagactgcaacgtgaactcttcactatcattcactttacaggtgctatcttctgcccggtatcaaaacagacatccctgcatgatgtgtgtatggatcataccatgcacttgtgcaactctaattattcctttatctgcagatctgccgagttgaagatatccttgttgagggcctcatagaaggatctgttattcatttccacagagcaaggactgtaaatgtgcaaccttttggaattattagcacatcagggatgggtctgttcttaatttccttcaatttatattcgatgttgtcattgtacattgcatgttatttcttacagttcattcctttggctgtcatctgcgatgaaggtataatcatcagtaagcagcaacagaaaattgactaaaaagaaaggatggcggcagaaataaactgccactattttttttttataacactaatattatattgtagctgatataaacccccacataactttttttttaaatatttaaatcatacgttgggggtttataaaccccacagtatcttttttgaactattatgacatattaatggggttttgtaaaccctcgcaatattttttttacacgtcgaaatcatattgcgggggttttaaactagcactaattgtctttcaaaacccccacataactttatttctttttttaaaaaaaatatttaaattatattttgggggtttttaaaaccccgcaatatcttttttttaaccattataatcatattgagggggtttataaacccctgcagtattttttttttgacacatcgaaatcatattgcggggattttatactaccactaattacctttcaaaccccccacaaattgaaaatttattttgtggaggttgtcatggaggttttaaaaacccgccgcaataatgctcgtggcaaaggtaactgtggcacttctagaaaccgccacaattctttttgcgggagtcaaaaaccgtcacaatttgaccacaaaattcccacaaagtaactgttttcttatagtgaatattaagcaaatgagctccaaattcagtttttttttaaccactagatccttatcgaaattacggagccataggaagaagaatcgtcgaattccgagttcgtatgagggagttatgctcatttccgtgtcgggagaatctggttgctgtgaaaaccgcataagcggaaattgaccgcggatgcgggaccgcaaaagcagaaatagaaccgcaaaagtggtcctgcatatgcgaaaaatgtccgcataagcggaaaatgggcctgggcagagacttcaagtcccgaaaatggccatttctccaccattttaagtccattttgagagcttttggacggggattgaagggagtttcaactaagatcgattgaaggtaagttttatgagttaaatacatgattttattgaagaatcatcctagaaatccatgaaaacatagccaaatcatatgaaattagcgcttgagattgaaattataaaatggtgatttgaggggacatatgaactccgattttggtaaattttatatgtacggactcgtagcgagataaggaacattttgatgtgaaaatttctggatttcaagatatgggcccgagactcgggttttacaaatttcatgaattttgatatttttcgagtcatttcgattgggttatatttccttggcataatgtaatgtattcgtggtggttttggctagattcaacgcgcggggaggtcaattcaagaggaaagggcattgcggactagtctacggccggttagaggtgagtagtttgtatagatgatgacctaagggtttgaaaccccggtatatcacactgtgacgctatattgaggcgtgactcgcaccccatggtaggtttgggatcgtatatgattggggattatgacttggtccatcccgagtgataattataatatattggcaactgatacgcacattgtattgatgatattgggcttgttgccttgtttggggccttgtgccgacttgtagaacccttcggggattgatgttatcattgttaaaatacttgcatatcatttggttatagtccaaagttttaaatactgttttgcaaactcagccacgtttcctaagttttgaaaacacaaatgatactttaaatgctatttcgagctgatgattattgttttacaaatgcccaagggccttatacgttttctggactgtataatatgacttgaaacagtggtaacaatggcactgtatgatataaattggtcaggtaacaatgactgaccattgcgcttgggttgtaggagcccctccggagtctgtacacatccccagtgagcgcgggtacccatatggatcgggctgcacgccgcagtggtcatgtgcattgcattgcatacatgcattcatacttgtctgatatatctgaggtggttgtgttgctatttcatcgcatgttatattaaattgatagatttagctttacattgtagcatttcgtggattcttatactcagacattatatatgcttattactcactgagttggtagtactcaccctactccctgcacctcgtgtgcagttgcaggtattgctttccggaagggggttattagcggattgaaggtactatcgtagctgagcaaggtgaccgccagcgttggcggcaccggacttcatctttcgaactctagtttgtactttatatttattattggtccagtagtggtattcagtcttctgtagatgctcgtgacttgtgacaccccggtcgggttgtattgggataaaaattaatagtttaatgccattattttgtattttctactcatttatgtttacaaatttgtcaaagaaaggttttggggtagttggctggccttgtcttcacgagaggcgccatcacgatcaagtatagactttgggtcgtgacaataaagcagtattattttaaagggtatctacaaaattactatatttatactacaatctatgttaaaaaaaatattgagtataaaattttctctttatctacaaaatttcaagaaataaactacaaatcagtttaagtattgtataaagtagtattatttttaagggtatctataaaattactacatttatactacaattaaactataatctatgtttaaaaaaaatgttgactataaaattttctcttcatctacaaaatttctacaaaaaaaaaccacaaataaactacaaatcagtttaagtattgtataaagttgtattgtttttaatgctatttacaaacttactacatttatactacaattaaactataatcttatgtgaaaaaaaatgttgacaacaaaatttgctcttcatctacaaaatttctacaaaaaactacaaataaactacaattacgcccaaacatatccacagatacgcaagagagacgtcatcgtgaaatcctcaggattagactcaggcaatttgcccagcacctttgttacagttagacaagaaaaaaacagcttcacctttggatcagcaataaacagaacatacatggacaatgaagacttcaaagatttcttcatcaagaatattaatttacaatttcagaatcattgattgatcgattgaggaagtcttctgtgtcatacatctactctcgatctcgtagttgttaaaattcagaaaaatatctgacaattaccagaaattacaataactgaaacaataggtttcatattgaatctctttggctaaagatctgattataaaaaatgagtctcatctctgtattttttgagaagaagaaggaatggagaagaaaaagaaatgggagtgggaaaatggcgctggtcagatcttaggaattaaggggagagagaaacgtgggatatatggacacctttaattaaggagtaaaaaattgtcaattaattatacctctaaattaattatggtatataaattgtaatttggtatgctaaaatgtaattaactcaaaccttaaatattgagggtattaaggtttcatatgtggtatatgaatatgggattcagacctggatcatccagcaaacaagggaattgaagcgcccaacataaccacttcttctgtccaccttttagtttctgggggaaaaactaaaatatttaaggggttatatatatatatatatatatatatatatatatatatatatatatatatatatatatatatttaggctaacatgtctcatgacccatctacatgcaacctaagtccgcctctgattgcaacatcaggatttaagaatccatcaaattcaaccgtcaaaatcaaaacttttcagtttcttctatatattctgtggttttagcacagtcgatttacaatcatacctggcttaattagtggattattacgtattttaaacatatgtgcattttaaccttttatcgctttttaactactcgattatgccgttatggaattatcttgaaacaaaccatgtgtgtacgaatctgttttatttagtgtgctaaaaatcatgttatgtgtacgtgtacacaattaataacactttattatttgttaagattttttggccacagtcgctcggacgcataccttgatttattttttgaatcataattatgttatgcgaatgtatacataattacgatagtagattaaaggcacgcttaaagcattctaccctgatagatgggtttgtatacgatcaaaatcatatgcatttgatatataggctcgagaggttgcatcgaaggactaagtgctcgagggacattagagccaagctcaggctcgaaggtagaataagaggctcgaagacataagtgctcgaagaacatcagagccgagtaggacccactccgagacagtgccgttacgagtttgttatagaaggacaagattctcgtcatgtccccaagatcatggcgtaaatttcggaatagatttgtatttgtacgaattagtacatattcgtactaggcggttatacagctgtccaataagattccttactgtaaatagaaatgtaccttatttagggttcccctattatataaaggggaccccaatcatttgtaaggatcatctaaacattagcaaataatatactatcctacttttctcgctcattgttcatcagaattctcctttagctttattgttcttgctttattgctgtaacgacccgaccggttgttttgagttctagcgcatcactctggagtctgagtgcatgagcagcttcatttcaggtattatgacctgtacgcgtggtcggaattgaatttcggtaagtttagagtggatttggtatgagaattctcattttgaaagcttaaagttaaagcaatgaactaggattggaattttgagtgaatgacctcgaaatcgggatccgaaggttccaccaggttcgtatgatgattttagacttgggcgtatggctggatcaggtttggatgacccgggagcattttgacgcctattgtggaagttgtattttggaggaatttcataagttgggcttgaagtgaatttcggtgttattgatgtccgtttgggattctgagtctaggagtagctccgtctagtgattctggagttgggagcgcgatcggaagtgaattcgaaggtccgtaggtcattttgaagtcattcggaaaaagataggaaattgaaggtttttgaaaagtttgaccggaagtggactttttgatatcggggtcggaatccaattccgtaagttgaagtaagtccgtaatatcaaatatgacttgtgtgtaacattttaagttaatcggacgtgatttgataggtttcggcatcgaaagttgaagttggaagatctaaagttcataaagcttgaattggaggttaattcatgattttagcattatttgatgtgatttgagacctcgagcaagtctgtaatgtgtcatgggactggatggtatgattggtttgggtcccgggggcctcgggtggttaacggatcgaacttggagttgaagaagggctgaagcagctgatatctggtattttttgcacctgcaaagaattggccgcaggtgcggagccgcagaagcggccaagaagaccgcagatgcggattttggtgaagggagctggggccgcagatgcagtcagggagttgcagatgcgggaccgcacctgcggaaagggaagcgcagaagagcaagttgggcggcttaggaaggagtcgcagaagcggcttttggaccgcacctgcggaaacgcagacgcggtcaagggaccgcaggtgcagaaactgctgaggcagtgtagtctttttaaaatcgggtttgggttcatttcaaccccattttcttccattggagccgattgggagtacctttgaggtgccattttcatcactcatcatgaggtaagtaatttatgctagcattgagttaaatacaaggttcatgtatagattttggcatgtaaatgggtaaaactttgagggttagaggaagacctagaaaatttgtattcttggaatttggccacgcttttggttatggaattaagaggtaatcatatatttgagttcgtgagttcatgggtaaatttgtattcgagaatttttagattccgggcccgtgggcatttttgttaacttgtcattcggggttaggaattattataaattgggtggtaaagtataattgagcatatattaatggattataatcattggctagttttggagcatttcgtgttggttcaagtcttcggaagaatgtagaatgccggttatggatcttcggagcaaggtgagtctcttttctaaccttgtaagagggaattgtccccataggtgagttaatcggttatgtgctcttatttgtaggggctatgtatgtacgaggtgacgagagtccatgcgtagctactataatgctattgtccggatagtttaggacccaaaagcattctatacttggattaattgtaaacttatcgacatcctgaattgcttaaaacacctagaattagtaaatgaatttctaaaagggttaaacttcattttcttaaatgattaaaagaggaattggttttctttggataatcgctccctgttgccttcttaattgattgtttgagcatgtattcctgtgtgtacctgcgtcacatggataatttgcgagcagggtatttgtttactttatgttgactgcgtcgcatggatgattcgcgagcatggtatttgtttactttatgttgacctcgtcgcaggatgattcgcgagcgggggaaatagatgcatcaattggttcgggccgtttgaccctcgacagtgcacaatttatatttttgttggatcagaccgtcgcctcgacatgatatgcgcatgtttatgttgctcgtctgaaatatttgatattgctttctgccttctggatcggatataaattgctaaaaataaataaaaagcaaatcatgaaagtcccttatttcttgtaaaaggtatttacctgtttacccgcttcgtgagttagaaaggctatgtgaatccatgatttccccgcattttctttatatatctttattggaccattagcaagtgtcaaatgttgaccttcttgtctttacttcttcgagattaggcgggatactcattgggtacacgttgttttcgtactcatactacacttatgtgcatttttattgcacatgtctatatgtggctagtgacttagtggcatagcggcatggttggcacagagactaggtgagctgtattttcccgaggcaattctgcagctagtatatctctttcagttattgcattgattttctatccaattgtattccggacggttattgtatttaattggttcctcttagaaattgctcatgtatttgtgacaccgggttctgggatgtaattgagtttaatcagaaattttaaaaagttgttaaatgtgcctttagatcttttattttctccaatatctgtattgtgccaagatcaatcttgctcacatcatcttttattgtcgatcttgaaagaagctgcatttgaattacagaaagtatgtctcccacaagcactccaaatttttataagacttcattcagcctattaccattaataacatgatttggtatatcaccgagaaaaactgacaagaactctagtgccacatcaatgtttcgagcagagacaatagtggggaagttatcaagctttttatctctaagatacaccagaaggcagtggagctgatatgaaaatccttttggcaaattcttgtccttgaaagttcttgattgagtaaactttgacgcctttagttcacagagaaaaatgtttttcatttccagctccactatcacaaccaagcatagtagataaggtggcttactctcgatatcagatgtatcatctccatccattttaatccaaagagcacgacagaattgtcgcacattgtcagccatgaactgtattcgagcctgcataccttccaacgtttcacggtcgacataaccatttatctctgcaccatataagtatcttataaatcttattttgttttgaatgactttgacttgccttaagtatctatctgtcttctgcaagatattgattttttcagtgaagaaagcgatagatcgaaccaagtacctcgtgtcacacctcctttttcctacacccgcaggggcataaaggagtttttcacttaaaggataatcggaacggaatttagttattaactattcagagtcgccacttgggagattaatggtgtctcaagtcaccggttttaatcccgaaccgaggaaaaatatgactctgtatcacagtccgcgaaccagaaatctggataaggaattctgttaacccgggaaaaggtgttaggcattcccgggttccgtggttctagcacggtcgcttaactgttgtatttgattttatctgattttaatacatgctagcttatgtgccttttatttgtaaaccgcttttctatcattatttattttaaaagaattacgacgtcatgaaaatgtgtttcgaaccacgtcgcaatcaatgcacccgtggtagtcgacatatttcgatttcgtcgagatttggatttggatcgcatcaatgcgcacccgaatttaagaaagtagtttagttaaatcgtgcctaaagattctaacgtaatattattttggggaaggccgtgaaattcactaaacgaccctcccaaattctaagtagttttatagaacatttattgagggccccgcctttgtagtttcatatggcgaggctcgtctcattttattttaagggaatacctaaaagcaactatacttttctatttatttgttttgtctttaaaagataaaaatcctaattacttttagaatttgggcttcaaactggtgctactacttaagtcttgaagaaatctccttggacccaaggccaaatcgctggcccaaaagaataggcccatggcttgcccccccccccccccccattttccaattattgaatcaccatcagatcaattccgaccagactcaaatgggatttcaattgcgggcgcaatcacaggcaagcacacatcaagccttcacagccatcatccagtttaattaaacaaagtaacgccagaaatccattcgagttcatagcattattacaagtgttaacctaaattctaatactaatattgagaataccactttaaatttctataccaaattcagacacctacttaagcgatcaattaaaaggatcaacaattatatcatggaatcaatctaagtaatcagacgttgaaggccaataatcaattaatcaatacaaactttacttttagcttgaacgaattaagcaaattacctaatatttatgctaagcaacagtctgattaacaaattgaccaattgtgagtccaaatttatacaatttacccctcaaacaaaatgtcctacatatatgaagcgaaaacagaacaggaaaacttcaaaagcaaattccactttattcatcagtttcgattcttcaacatcacatttacaaaggttccttcacaattcatatgagattgggagagatacctggaaatataatgaacagaaagggatgttagcaacagaagagaagacaacagctcacagcaaccaataattggaattcaaacaacaccaattagcccagaaatgcatttgacagtccaggaagagttcagaagatgaaagaatcaggaaaacacttgaatccacccaattaaactcacaattgaacccaggcaatctagaacaccttcagcaacagaaacaactatacaacaactccaatagatctcaacctcgaatttgaattgcaaaaattccagtggaacagtacagtttttagttttatttttgaatttttgttttgtttttggattttgaatttgaaatctacttcagatctaaaattcagaatggaaagagtattttcgaactaataatggctatgaaacagtgaatttttctgaagaagaagccccctttcacaaggtaattcaatgccttttatagacacccaagcaaacttttatttctaattagtccctccctcctttatcttttgacccttttatttataacttgtaacacaagtaacccctatctagaagctcctaggggttacacattattcttgtgactatcaatttcctacagtgcccttgaacttatttcaaatttactaaaatatcttaaacagctaccaccaattctcctagtaattacccatcaaaaacacttaatcacactcttatccaaacccattcaattaatccaactaatccaattgattaatcaagcacctaacaatccaactattcagacaaagcatcaaaaactaatccaaataaacaactaatagaacgaactaatctgacaatttaactaactaactatgaaattcaaccaactggaattaaaatcaaacaaatgtccagaactcccacatgcaaataaacagaaagaaagaaaaataataattaaaaaaaaagactagaaaacttattgacgaacatgagactccggccagccgttaatgtccaaatcccccgaaatttcaaaccagtaacatccctaaccgtgtgttttcataagaaaacacatggttagtgttgttacggtccgaaattatagagattgaaacttagggtttttggtcggagactttgaatgaagattcaagcaaatccaggtagattcgagagatatggctatgggggtcgggtagaggaggctcaggcggtcacatggtgtgattttggggccatttggcataactaatgtcatggccgaaaaaccttctgatgaagattcgatgagatagggaaggattcgagggatggcactagcagggatgggaagagggtgatctagggaatcgatggtgttaatttgggggcctttgacgcgggtggcgtttgccgacggtagggatccggcgaggtgcagagaacctgtacgaggaagagggttacggtctctgactttctaaaggatccccgaccattttatttaattgacctaattgatcctcagccactggatcaagataatcagacggttgtgatcaaacaaagtgggacgacgtcgttttgatggaggacttggaccgggcaaggtgctggttgggatggggctgtgacgaactaaaattgggccaaggaagactagccacagatggcccaaattgcattaacccaatccttttattaaaaccccttttgttttctcttttgcctttatttcttttgttttccactttataaattgtattttttccttttttatagttttataatgataaaaataaaacttcaaaaatgaaaataaaatcctaacattaaactaactaactccttataattatctaaaactattttgtgaaaaattccaatcaaatcacaaaatgaactatttttgttatttcttcatattttttcaaaaataaattaactcctaattaatactaaaattcgaaattaaatcctaaactaatgccaagtatttttgtatttttcgtatgaattaacatgcgcgaataaaatgcaaccaattaacacaaaattcacgaaaatgtaaaaataaggagattgttttatttgaatttttaggaacaatttgcttagggcaaaaatcacatgctcacagctgcccctctttgtccggaaacacgaagagttttcgtgcgaagacaagtgagcgaaaatgagcgatttttgaccattcacatattccgtgtgaagcattttttgaaaagcttgaccgcaccctgcttcagaggttgcctacatatgttgggctaaacaggaatcaggtcagtgtagttcgggagtgtctggtagctgggactaccaggagctgtgatttcactgtgattgctgctgctactgcttgctgacctcccttattacaccatgtcaaaataaaagaagctagactaagctataaactatgaattacaaaagtcctatctaaaatcttcatacttgcacttgtacttccttattatcttgttatcttgtgttcccttggtgaaatccactgtcgttacttcaacttgctaagtgagatgttgttccttctcttcaaattgctgagcttgaataaacttgaacttgaatatattcctctgttatctcggcgggctcccaacttttgaacttgaatttgaaagtattcctactattatccaggcggactcctgattgctgaacttgaaattgaatgtattcccctgttatccaggcgggctcctgacttcacgaaaagagacaaaacaaagaaaactttctgccccagtttggcaaactgggtgcttgttaccacatactaataagaattgaaaactaaaacttgaattgtgataagaccgagatgcaactttgaaaacttaaagactgaaatgtattcccttgttataggggcaggctccccacttcaaaacttaaaatttaaagactgaaatgtattcccttgttattggggcggtctccccacttcaaaacttaaaatttaaagactgaaatgtattcccttgttataggggcgggctccccacttcaaaacttaaaatataaagactgaaatgtattcccttgttataggggcgggctccccacttcaaaacttaaattttaaagactgaaatgtattcccttgttataggggcgggctccccacttcaaaacttaaaatttaaagactgaaaggtattccctttttatcggggtgggctctccacttcaaaacttgaattttaaagactgaaatgtattccttgttataggggcggactcaccatttcaaaactaaaaatttaaagactgaaatgtattcccttgttatagggcgggctccccacttcaaaacttaaaattttgttctaaaatgcaaactttgaaacaacttacctttccctatcttattcctcattatcttgtattttaaccatgccacacttgcggtcaaacctgattactgcttgctttccctcatggagaaatcctcctgaacaaccaatttcctgcccctgtttcaatcaccgaaaatttcgttagtttaaaatggtggttagttgatggcattcttgctgaacaatccttccactgctttgctttgtattgactgacttcctctggaccgcttgactttctgacctacttccaaattccccaatctctgataacccgaatgcttttttacccgtgctgttgtttcacttttccaacccttttgactgaacctttacatttcctacaacatttcccaattattccaccgatgaaacttccggcgactttccatattccactttacatcatgttgttgttgacacgctctgaccacatcatgctttaccgctttcggaagctggtagtgagctttgaaatcctttcccctttgcattgaacaaaactgatattggaacattttagacagacaaaacccccaaaagaaaatgaaatgaaatgattttatgagttaaggataagaagaatccaaaaccagataattgtaaaaaggaaaaagaaaaaagaaacttatctgaccagaacagctggcaccaatgatcatgacatgcatttcggactaaccggcccaacaaatccaactaaccagctttcagttgccatactttattgccccaaaatttccatcacttgattactttaacctaaccttaacctttttatcttgcggtgcctcaaaatagttttttttttaccaacggacctttcttagtttgccatttctcaactcactttcgccttaaggtgcccgtgagggttttcaccactaagactctctcattttacttttctctcagctcccgtcgccttacggtgcctgtgcaggttttcaccgataagactctctcgtttttatctttttgttttccttgcttgaaccaaagtttttccccggtcatgaattatctctacctgcttaacttggcattttttaaaaattgatcagaaggtctttctttggaccgtaatataggcttttagatgggttagaaagaagggtataaaaggctcgaaacaacttccaaatgggttaagactacaactttcggaatccaatttctttctacaatcacaacttctgccccaatttcttgcttggggatctttggatttttattttggtatgactgaaccttggagtaaggctgcctacgtaccctttcgggatcaagtcaaacctagttcacgttatcgtaattgcttttgttgtgattctttttttttttgttctctttcttttctttcttttcattttctttttttttcctttttcttctctttctttcttttctttttcttttcttttctttgtgttcggcacctgcatttctttgatcatgtcgttgattccgaaagagggatatgaacaaaaataagtaaggctcaaaggggatgacaagggataaagtgtttggatagcagaacagaacgccttcgtcagttaaatctttaaaatatgccaaatacaaacaagtacatttagaataagaaatcatacataatatctctagaccgcatcggaattaatggccatttctacatattttccttctacatctttcaaatatagtgccccattagacaacactctagttacaacaaatggtccctaccaatttggagcgaactttccttttgcttcagcccaatgaggcaaaatgcgcctcaatactaactgcccgacttcgaacttcctcggacgcactttcttgttatatgcttttgccattcttcgttggtagagttgaccgtgacacactgatgccaaccttttctcatcaatcaaactcaattgttccgacgggtctttacccattcatcatcatcgatctcggcttccgctatgattcgaagtgacgggatctccacttctgtgggtattattgcctcggtgccaaacaccaatgaataaggagtcgcccccactgaagtacgaaccgtggtgcggtaccctaacaatgcaaaaggcaacttctcatgccactgtctagacccttctaccatcttccggagtattttctttatgttcttgttgggtgcttccaccgcaccatttgctttagggcggtatggagtggaatgacggtgagtaatcttgaacttctcacatgtctcctcatcaaatgactattaagattagccccattgtccatgataatcacctttggtatcccaaaccgacaaataatgtttgaatgcacaaaatccaccacagctttcttactcacagacttgaacgtcttagcttccacccacttggtaaaatagtctatggcaaccagaatgaacctatgcccatttgatgctgctggatcaatcgtcccaatgacatccatgccccatgcaacaaaaggccatgatgccgacatcgtatgcagttctaatggcgaagaatgaatcaaatctccgtgcacttggcactgatgacatttgcgtacgaaactgatacaatgtcgctccatagtaagccaataataccctgcccgtaaatcttctttgccaaaacatatccgctcatgtgcggtccacaaacaccagaatgcacctcagtcatgatagatgtggcatgtctcgcatccatgcacctcaatagtccgagatctggggttcttttgtacaatactcctccactcaggaaaaacccacttgccaatcgtcgaatagttcttttctgatcaccggtggcctgtactggatacacccccatccaaatatattccatgatgtcatgaaaccatggctcaccgtcacgttcctcttctaccatattgcaataagcattctgatcatagaattgaatctgcaatgggtccacgtaagccttattaggatgatgtaacattgacgctagagtagccaaagcatcgacaaactcattatgaatcctcgggatgtgcctgaactctatcgactggaaccgttgacaaagctcatgcaaacacttaggtatggtatcagcttcagatcccatgtttcccattctccttggatttggtgtaccaataggtccgagtcacccatgaccaagacttcccggacacccatatctacagctaatctcaaccccaaaatacatgcttcatactctgccatgttgttcgtacaatagaaacgaagctgagccgtaacaggatagtgctgacctgtttcaaaaataagtacggctcctattcccacgcctttcatatttgccgctctatcaaagaacagtctccatcccggtttctctacctattctagctcatcaatatgcatcacctcttcatcagggaaataagttttcaaaggctcataatcatcatcaactgggttcttagccaaatgatcagctaaggcctgtgctttcattgcagtccgtgtcacatagataatatcgaactctgtaagcaaggtctgctactttgcaagccttcccgtaggcataggcttctgaaaaatatacttcagcggatccaagcgagatgtaaggtaagtagtgtaggacgacaaataatgtttcaacttctgtgccacccaagttagggcacaacacgtcctctccagatgagtatacttaacctcgtaagatgtgaacttcttgctgagataatagattgcctgctccttccttcccgtaatatcatgctgccccagtacgcagccaaacgaattatccaaaactgttagatacagaatcaaaggcctccctggttctggcgggaccaacacgggtggagtcgacaaatatccctttatcctatcaaaagccttctgacattcctctgtccacttaaccgcagcatctttcttcaaaagtttgaaaatgggctcacaagtagttgtgagctgagcaatgaacctgctaatgtatttcaaccttcccaacagacacatcacctcagttttgtttctcgaaggcggcaattcctgaatggccttaatctttgatggatccaattcgataccccgatgactgactataaatcccagcaacttcccagatggcaccccaaaagcgcactttgcaggattgagcttgagattgtacctgcgaagcctttgaaagaattttctcagatctctgacatggtcaaacttctgcctagatttcacaatcatatcatccacgtacacctcaagttccttatgtatcatatcatggaagatcgttgtcatcgctctcatgtaggttgccccagcatttttcaaaccgaatggcatgacccgataataatatgttccccacgacgtgatgaatgccgttttctctgcatcttcctcgtccattaagatctgatgataactcgcatagcaatccacaaaagaaccaatctcatgtttgccgcaattgtcgatcaatatgtggatatttggcaacggaaaattatcttttggacttgctttgttaagatcccaataatcaatgcacaccctggttttaccatctttcttcggcacatgcaccacattagctaaccaggtaggatacctcgtaacccgaatgaccttcgcgttaagctgtttggtaatctcctctttaatcttcacacttatgttcgttttgaactttctcaggttttgcttaataggagggagggatggatcagtgggcaatttgtgagacactaaataagtgctcaacccggcatatcatcgtaagaccaggcgaaaatatccttgtattccaacaacgccttgattatttccttattgagctgcggttccagatgaacacttattttagtttcacggacattatcttggtcccctagattaactgcttctgtgtcccctagattaactgcttattttagtttcacggacattatcttggtcccctagattaactgattctgtgtcatttaggtttggtttgggtttttcctcaaagtgatttaattccttactgatttcttcataggcctcatcatcatattcatcttcatcatcacattcaatttcttgtattattatttttgagtttggttggcttataaaactgggccgaggattcctcatgcatgtcatgtcattgatatcagcataaaaagaattatacagaaaagaaaaagaaaaatggaaacaaaattaggaaagaggaaagaaagaaaattgcatttcattaaacgtaaagataacatggtttagctcatccaaatggatggaacatagcaacatggattaaaaaccctggaataatccaggtgaaacaaaaggaaaaacaaagacccactactgcgactccctccgagttggaagagaagtagcttcccaattgttgatactaccatgtggcccgatgtactgaatgtctgcattgcttgaaccttcaccaacctcaaccacgttcacttcggcaatcactctttcaaacaccttgttcaagttcccctctgtaccaatcagtggacccgacacctttatcaatgactgctttttggcaccctgtcggacgaatgacctggacaggcgtggaattggtttaggaagaacccaagctttcttcttcattttacgagcccttctaacatctgctgctgttgacttaaaacctagcaggttgaataataccctgaagctcagcccccagacccttccctggcacgaacctattactcagcatctctgaaactaccatgacggttgcagctgctaccctagggagtggaacgcttttaccctccggcaccttgttcaccgggatcgtgtcaaagacctgataaacccacggccccttatcgtcatcagtctctataaagggaacgatggcatcacttacagcgcatgtggggtcttccccatgtagcacgacctcttgtctgtcccattcgaacttgaccatttgatgcaatgtggaaggcactactttgtccgcgtggatccatggtcgacccaacaaaatattataagatactgcagcgtccaacacctgaaattccatagtgaactcgactgggccaatggtcaattcgagtataatatccctcactgtgtttgttccacctccgtcaaaccctcgaatgcaaacactattcttgtggattctatcatcatcaatctttaacttgttcagtgtagaaaacggacaaatattggcactagacccattatcgatcaatgcccgaataaccacggaatcttcacacttgactgtcaagtagagagctttattatgctctgtgccctccacagaaaactcatcgtcagaaaacgtcaccctgtttacctcaaagatcttgttggcaattatctccaggtggttcactgaaattttgtcaggcacatgagcttcattcaatatcttcatcaaagctcggtgatgctcgtccgaatggatcagtaatgacaataacgaaatttgggccagtgtttttctcagttgttcaacaatggaataatcctgtactttcatctttttcagaaattcttccgcctcctcctctgtcacagccttcttgactagtactgggttgtctttaatggccctgaactttttcaactcttcaggagcaaaacaacgtcctgaccaagttagtccctgtgcctcacaactctcttcctcaatttcctttcctttgtacgtcaccactacctttttgtacttccatggcatgactttgctatcaatcacgggtaattggactaccggctttatgataaccggttctatgtaggccccattcacaacaactacaagcgcagatgatgcccctggtactgctaacttgactagctctggattttttgcagcaacagacggccctttccccattaccaccgctggcttattatttatctcttttgactgaaccgctggctttgtactaactgccttttctttgaccttggcttcagtagaatggatcatcatgaccgtctgcgagggctttttaggatctgtccccttgtgtatcagttcaatcatattggcttcataatgcgctagtaacgggttttgattgatgtttggcgcctccggagcctgtactttaatacggcgattatcaataagttcctgcaccgcatttttcaacctccagcatttctcagtatcgtgccctgtcatccccgagcaatactcacagctaacagaatggtccaggtttctgggaggggggtttggcgctttgggctcaactggggttaacattcccagctgtttcaatctatagaacagagtagtgtaagattctcccagtggagtaaaggttcttttgttctggaccttctcatttctaaaggtttggtttgggcgaaagccggctcctggtctgtaagccctggtaggtggataggtgttttgtggaggcgaatatgtgttttggggagccggtgcacgccattgcgggtgcaccggaggctgggtgtatgtctgggcgtggtagaaagaaaagtgtggttctagtggtggatagtaatgttgtggtgggccatatggggtatatgggtaatttgggtggtggtgtttgggttggttatagtagggtggagggttgctggacctggaccaagtactagcttcaactgtggcaacttcttcctcctttttcttttcgagcacaccaccagtaccactttggatggactgggtggttgctttcaatggtgaataactcaagatcttatttgatttcaatccctcctcaatcatggctcccatctttaccacttcattgaatgattttccaacggacgtcactagatgaccaaagtaggtcggttctaatgtctgcagaaagtagtctaccatttcgctctccctcatcggaggatcaagtcttgctgcttgttccctccagcgaaaaccaaattctctaaagctctctccgagattcttttccagttttaacaacgatagaaggtcggggactatctcaaggttatactgaaagtggccaatgaatgcttgcgccaagtcatcccatgtataccatctgccgggatcctgtctcgtgtaccattccagcgcggatccgctcaagctttgaccgaaatacgctatcaacaattcatccttccccccagctcctctcattttactgcataaacctcagaggtgggccaccgggtcaccgtgcccctcatacaaatcaaacttgggcattttgaaccctgcgggcaactggacatcaaggaaagggcacaaatctttgtaggcaacactgacttggctgcctaaaccatgcatgttcctgaaggattgctccagtcctgttccgcattcttaaccggtttctcaacttcttctgggatatcaaaatggggtgtataggtgtatggctcaggagctttaaaagtgggttctggagggtaatattgggtgtcgtgagcttggaacagcggctcactggacgatctttgtaatgtggctggaggaggtgccacaaagattggacctatgggttgaggagggttctgtttgggtggtggagctggaggggtgtatgaagtagtggcatagccctgggtgttatacgggaagggtggagatgtattgggagtggaaggctcctgagcttgcactagaggtgggatataggatgggttggcagggtacaaaggtgtcgggtgcccctgagaccaagcttggtacatttcagccatctgtgctttcaatttccgcatctcttctttcatagcccccacatcagtcacctcaacctcttttgtaggatccacgatactagtgtccgagtcctgtccaatcatgtctaccttatctttctaccgggtgttgtacgggtgagttgccagaattgccaatcaactaaccacgtgcctggactcacacatttagacaaccactttgttagcgattaggttttaacagatttgataaccgcacgttggcatgaatgcacttatacagttaatcatttctattatgcgtttgctccatcgcgtgcgtcatcccgacatttctttctttgtttcttttcacttttccttttctttcttacttccattttttctcactctatccctgtcttgttttcccgctcttttcttttctttctctttctctctctcttattctcgcctttgtttttccgctcttttctttctttctctttctctttatttccgctcttttcttttttctttctctttctctctttcttttccattttctttttttgtttatgattacggtcgaatcctatggagattgcctacgtatcgtgaccccgcacgaatcagaccaagcgtagttcgtgaaaataaatgcaaaaataaaaagcaaaatttttttttttgggaattttcaattttccattactaaaacaaactattacaaactaaacactttgcagaaaggaaataacagacacaaactaaaaccaaatgcgaactccaaaactacagacacactttgacgcgaaaagacaacagacaaacagactgaaaatagagaaatacagacacgaactatgcatactctaatgcttcaaacatgggtgcccgcgaggcatcgttaggcctcgccgcgggcctaggttccaaatccctttcaagttgctctaattcattcatggtccgcttcacatagatcatcactgctgagacgaaagtagtatgggtcatgtcttcacaggcccggcatctcctaaaaatggcgtgagcaatggccctgatcccgtttcttgtttgctttttttctataagcagtcgttttatctggttactgcatgtctttaacgcctgagaatcctgcatatgctgatcctgcagctgctgcacttccacctccatttgtgccaacaggtcgtaacagtgcccactttcaatttcaaaatctctagtctgcttaaccgctttcccttcaagggcaaccacctttctcttcagattggcaacaattttctcgtggtcccttttcaattgatgcaagtactggtgacgctcctctaatcttttggcccactgtgctttgagatctgccatgacattctcagacttttccaactcatcccgacattccctgacttcatttttcagcccttttatcaatcgctcatttgatcaactcttcggttgtttatcaccggctattctcaattgctggatttgggccctaagcacctcgttttctcgggccaaaatgtcctacatatatgaagtggaaacagaacaggaaaacttcaaaagcaaattccactttattcatcagtttcgattcttcaacatcacatttacaaaggttccttcacaattcatatgagattgggagagatacctggaaatataatgaacagaaagggatgttagcaacagaagagcagacaacagctcacagcaaccaataattggaattcaaacaacaccaatcagcccagttttagcccagaaatgcatttgacagtccaggaagagttcagaagatgacagaatcaggaaaacactagaatccacccaaataaactcacaattgaacccagacaatctagaataccttcagcaacagaagcaactatacaacaactccaatagacctcaacctcgaatttgaattgcaaaaattccaatggaacagtacagtttttagttttgtttttgaatttttattttgtttttggtttttgaatttgaaatctacttcagatctaaaattcagaatggaaagagtattttcgaactaataatagctatgaaacagtgaatttttctgaagaagaagccccatttcacaaagcaatagaatgtcttttatagacacccaagcaaacatttatttctaattagtccctccctcctttatcttttgacccttttatttctaacttgtaacacaagttacccctatctagaagctccaaggggttacacattattcttgtgactatcaatttcctacagtgcccttgaacttatttcatatttactaaaatatcttaaacagctaccaccaattctcctagtaattaccattaaatacacttaatcacactcttatccaaacccattcaattaatccaactaagccaattgattaatcaatcacctaacaatccaactattcagataaagcataaaaaattaatcataataaacaactaattgaacgaactaatctggaaatttaactaactaactatgaaattcaaaccaactggattaaaatcaaacaaatgtcccagaactcccacatgcaaataaacagaaagaaagaaaaataaaataataataaaaaagagactagaaaacttactgacgaacatgagactccggccagccgttaatgtccaaatccaccggaatttcaaaccactaacatccctaaccgtgtgttttcataagaaaacacatggttagggttgttaaggtccgaaattataaagattgcaacttagggtttttggtcggagactttgaatgatgattcgagcaattccaggtagattcgagagatatggctatggggattgggtagaggaggctcaggcggtcacatgttgtaattttggggccatttggcgtaactaatgtcatggccagaaaaccttctgatgaagattcgatgagatagggaaggattcgagggatggcactagcagggatgggaagagggtgatctagggaatctatggtgttaatttgggggcctttggcgcgggtggcgtttgccggtggtagggttccagcgaggtgcagagaacttgtacgaggaagagggttacggtctctgactttctaaaggatccccgaccattttatttaattgaccaaattgatcctcagccgctggatcaagataatcagacggctgtgatcaaacaaagtggggagacgtcgttttgatggaggacttggaccgggcaaggtgttgtttggcctggggctgtgactaactaatattgggccaaggaagattagccacagatggcccaaattgcattaacccaatccttttattaaaaacccttttattttctcttttgcctttatttcttttgtttttcactttataaattatattttttccttttttatagttttataaagataaaaataaaacttcaaaaatgaaaataaaatcctaacattaaactaactaactccttaaaattatctaaaactattttgtgaaaaattccaatcaaaccacaaaatgaactatttttgttatttcttcatatttgttccaaaataaattaacccctaattaatactaaaatgctaaattaaatcctaaactaattccaagtatttttgtatttttcgtatgaattaacatgcgcgaataaaatacaaccaattaacacaaaattcacgaaaatgtaaaaataaggaaattgttaatatttgttatttgtgccttttaactagtagtagcagtaatagtagtagttgatgtgtatatcaatgagtttcttgcttaaacagtttatgatgtatactgacttgggctttgatcaaacgatatgtgtttcaacagtttggttaaagttattgacattgaattacaagatgatattatatcaaatgtaaagatcctctatcacttcattggtctgacagaggcatcaaatcctttattgctagatatatacatatattgcagtctcatttatggttgctgcattttgttttccattatcatgaatctgcaacttctcaaattcaagttccttaaactaaacatatgggaaagaacaaattaaaccagataaaacatagatcacagcaaggagggttgaatttcgcaacacagccaacaaaatggtatattggttgtccatcacgaatcattactttcctgtcattgttaatccgtaagaggctgtacatattgctttttctgatttgcagtgagcacatgaatgacatggtctccgagagcaagttctgttattcccactccacaatcctaaatatccatataatcaaaaccaataaacaacaaaatctatttagtaacctttttggttttagagacgatcaatgaataaatcaattgaaataacatacactgatgcttcatgtccaagaatgcgagcaaagactgagttttgctcctacaatttccgaaggagttgagagaaaaaatcgacccaaacagattgtggtatttgttggaaagtagggaagttttttagattgtaaccagttttttattacctttgcttcccagaagtagatatcagtatagcggaggaaagcgtagaggatcttaagacgaacttccatttttttttggaggttccatatccacttcctcgatcagcaactgctttcctagctcccatgccataccagctgtaaaaacacatcatcattagctcaaaattactaccaaaattctcaaaaagaaaatgaggggaaaaaaaggaaaccaagaaagtttacattatgtataagaaatggagtgaaacaatcatcctacctctgtaatgaatgacttgccccacaatgctcgacatttgttttcttgatttccctttactgatcactgaaatatgaaaactttatgttgagcagagtttggttgttttctgaataccgagttcgattttcttgaggtgtgcttagtagatactaatatttatgaagataaaatgataactctgatattttttcttcttttgtgtgcgtatgtagcaattttaagtccataaagtatcatgttaatgagcttaacgaggagacgtacacatacaaatgcacattgatcgaagatgttgccttgtttaacaaccttgagtaaacaaataagactgtgaagtttgagcagtcagctgaaatccaagcaggaaaggagaaggtcttggctataaacaaagccgttgaagactatctcctactaaaacctgatgcctgtgtttaagattgttttgttctaagaaaggcttatctgctctttgtcttgtagttatcaaatttgttcatcttgtatgtttcgccacagttgtctctgctttgtcaatttttatcttgtccgaaaaaggtactattgccagctgctcatttactcggaacaataagcaactttatgacttgaagaggagccttggcgtaactggtaaagttgctgccatgtgaacagggtgtcacgagttcgagccgtggaaacagcctcttgcagaaaagctgggtaaggctccgtacaatagacccttgtgatcaggcccttcccgggaccccggaccccgcgcatagctggagcttagtgcaccgagctgccctctatgactaggtgaatttcaacaggtggatgattttcaattaagctaaaactaaaagaagaatttctacaatgattttaaatttgaagtttaatgttaagttaaacagccagggaagtgcttatatatacaagtgaatcaagattggatctactcaaacaacctaattacttgatttttcaagtttgtgaaagtaactaatttcaggtcaaggcaccatcctatagaaacaaggagcaattagagaaagcaagaaacttatttattcttttcttaaaaagaaggaacaagaaaaaactgaaacaataccatgatccgtagaggagcttttgcttgacctcgctgctgccggctatgttgcttgctgatccaaacctgtatcgaacatattttttgtacattagatgcacgttgatattcaaaaacagaatgtaggattttgtttctacttacgtccataatgagtttaagacggctgcatccttcaatctcttcgatgtcttccttaagtttcacagctgaaggctccagagtttgtggcctgcgcccagtcaacttaatctgtttcaatgtttcaatatctgcaaagctagggggaatctcctcaagcctgtgacacattcttataacaagcttttcaagcataggaaaagattcctctgggtcatccaaccttgagatacctaacgacaccagtttcaacaacttaagtttattgaacttgatatctttgaggcaccactcttccgacttaattccccaatcctctaatttgagatactctagatttggtagtcccacaattgagggagctccgcttactatatgaggccctttaagtttcaacttctttagatttgaaggaaagtgtaactcagttatactaaatccccaaccctcaaagaaaaggtcaagtaattgcagccgagtaagactctctagtttgggactgaaagtacaaatctctctagaacgaagccaagtgatagtgagactaagattttgaatgttaggacacctctgtaatacaccatccatgcattcaccatcattagctggataacaaacatgacttaatatcctcaaactttccaatttagaggattgttcaaagatcccctgcttaatgttttccaaataaaaagcaactccgttaatctcaacatgtctgagtttttccattttccaaaaaatcgggggtaaaactacgctctcggaagaaagaacaattaaagtttgaagatggcgtagatgtgattccggatggaaatcaaattgatatgtcctaactgcgaggtacttcagataaatcagtggatgcagtgtggctgacgaaaaagcctccactctatgagaaatcaaatccaagaccttaagaaatcccaatttactaatctgagggaagggattccattctaaataatctcctccatcatgtgttatcagtgaccttaaatgttgatcgaaaggctcctgtgtgagaaatgcaatcttcgaaagctcattagttaaattgatgctgagtcgagttcccttccaatcggaaggttgaaagttgctatagtgccccttcaccctcaacataaacttttcttctctgcttttctccaagcaaaagtgaagtactacatcatgaacctgacagtatttgactttaccgttatagtttctcttctcaaccatcaccacattactgctaatgagatccatcaagtaatcttcagctgcttcttccattgatttctcatattcaatgttctgcacgaatccttccgcgatccataaacttatcaatttagacactggaattatcgcgtcctccggaaacatccccatataaagaatgcaaggttttaaagaatcgggtaagttgtcataacttaactgcatagtcgaaagactatatccttcagactcacctagataggaaagtagagaatttttaacctcatgccaccaagattcttccattttcttctttttgattattccagctaccaagataatcaccaaaggcaatcctttgcatctttctgcaactgctaaactcacgttgtgtagttcaggtgggcaaccttcctgttggaacacttttttctgcaacaactttagactctcatcgcgtgtgaaaaatggaagagaataaggatcagtatcgtgcttgacttgcttacctacttcctcaagtcgggttgttactattattctacttcctgtttcaccatttgggaaagataatcttaaatcttcccacgctttaatatcccacatatcatccaagacaatcaaatatctcgtgccaattaatctttgcttcaacatgtgagcaagtttgccaacctcatctaccttggccttggaaccagtaacttgattgaaaatctcttgtaataactcttgtcgattatatgtttgggaaatgatgcaccatgctcgcacatataaatggtaaacaatgttatcattgttatacaactttatagcaaaagttgttttaccttgtccagccatcccaacaattgggatgacgtctagctccttttttccttcatttagacgcttaattattctttcagcgtctttctcaaaaccaactatctcctcatcattcatagggtcactctgtagattttgcatatgtttagatggctctgccaccaagcagggcctaatctccaaactcttgtcagacatcttccttagataaagtagaaaactcctgcaagttcaccatactcttgtcatattaattttcactaagaagtacttccttcgtttcagtttatgtgaatctatttccttttaaattcatttaaaaaatgatcttttttctaaatttggaaacagtttaacttcgatttcccattttagccttaatgaaaaacagtcatagccaaacaaatgttatcgcaggtctgaaagttggaaccacaagtttcaaaagccttatagcccagtggcgaagctagaaatttctccaagggtgttcaaatttaaaagaagtgaaaacaattcctacaaagggtgttcaatatgtgttatatacctctaaaacgtaatattttacctgtgtacacagtgcaatttttcaacaaagggtggtcagttgaccacccttatcagcatgtggcttcggcacttatatagccacacaaatggtatggcatatttaagaccacgagttctaaagtctttctttttttaattaaactttatactcagtcaaataggttcacataaattaaaagaacgggactgatttttattcatgtctatcaatactactaagagactataaagcttctgaaagattatacacacaatgctataagtgactgttttaagattattggtaatgacacatatttaaaagcatcaaaaaaatatcaaattgaagttctctggctagtctgatatatatcaaaaaaaaaattatcaagagtaagatattttatcaaggtaggaaaaaagcaaaatggattcatgtagttgttactagcaattgaaaaacttacagatatcaacttaattagagatttgagaaagaagtctcacaatcaatcagcgcctatttttttgtatcttcaatatctgatctaatcctaaaaatgagcgaaaaagataataattaaactttacaattataattaaaagcttaaaatacatatacggtgataaaataatgatttaaaaaggtgatagatatgatcaggtcaaccaaattatcaaggattaaaattgaaaattaattatggaacaacaaattaaaagttacctcaatgatcatgaatagaatttggcacaaggtgctgtgagaggataagtgaggagatcaaaccataattctagtttttaatgacacaaacagactgaaaggagctctcaattattttggttagttaataattaatggtaggtaaacagaaattattgcttgattaattaatagtgataacagccgcctgagtggaaaaggagatgaactttctctatcggtgcggtggaactacgggaacggcgtttagattactaacttattaagggtattgataggtaaacaacaatttattgcttaattaattacgtatgaggacggcctttgaatactagtattattcttgggcaaaaatcagtttttggcacctttcttggtttttgattaaaaatttatgaggcatacaccagtgtcttatacctattttttattattcaaaatatagttttaatactcatgtcagctcaaaaagattggaattttttggtgttctaactaaaatcctaatttcttctatgacttagtaactgaagttatcgggaaactgatgttggtcggaggtccggccatcttcactatcgcatagtatacattagcacacaagcaaagtttgataaatatttatcaaacaatcttaagctatatagcgtttggacatatatttgattgaaacttgaagccaaaatgtatggcgaaacaggagcttaattcaggatacttcgtacaattgtacagtagtcatgacccttaaggtcgaaagagagctaatgcttacgtatcatactgtgttattttagaatttcctcgcgaaggtagaatgtttcgtgagttatatatcttgttaaattctatgatgagcttgaggctgtactaattgagttggctgatgttcgtagccttcaagctctggggaacacaaacaaggctttcaaatctgcaaaatctatcaccgggaagtagtggtggcaaaatggataaaagaaaacaattatccatccatattatccattaaaaaatgggttggataatgaactttctaaaatccttatttttggttacacaattggttaatgattggcaagtgtagttagattcaacccactgcttctaaaattataggcatgatatttatgatgggcatcaagaaagtacagtcggagccatctgattttggtctacaatcatctgaattctgaaacataccgaaaaagagaagtataggaaaatgaagtaattcttccctgtaggctatgagtctatgttgatcaatcggataaaaacccttagccatcagtagtagtgtcacaatataagaggatgggtgtttccgccagctgcataatgatcatggcttcaaaaagttgctggtaacaatacacgaccacttcccttcactataatagtttctagatggcgcagatgtgattctggatggaaatcgaaatcaaatgtggaaactgcgaggtatttcaggtgaattaatggatgtaatgtagctgacgacaaacgatccactctattgcaactcaaatccaagaccttaagaagtctgaatttactaatatgagggaagggattccaatctaaaaatattcttacataggttgttatcactgacctcaaatgtttatggaagggattttgtgttttggagcccagcaatgcaatctcggaaagctcatcagtgatgtcaaatctcagtccattttccttccaatccaaaggttgaaattagctaggatgccccttcaccgttaacataaacttttcttctctactcctcttcaagcaaaagtgaagcactacgtcatgaacgcgtggcagtatttgactttaccgttatattttctccttgatgcatagtcgcatgactatattcttcaaattcaccaacatagcaaaacatagcacttttaacctcatgccaccaagcttcttccatttgcttattttttattattccagctactaagataatcactataggcagtcctttgcatctttctgcaactgctagactcgcatcttgtagttcaggcgggcaaccttcgttttgaaacactcttttctgcaacaatttgcaactctcatctaatgggaggaatggaagagaataaggatcagtatggtgcttgacttgcctacccacttcctcaagtcgtgttgttacaattattcgacttctgtttttatcatttgggaaagataatctgaaatcatcccatgctttaacatcccacatatcatccaagacaatgagatatctctttcctattatgcttttcctcaacatgtcagctagttcgccaacctcatctaccttgttcttgtaaccggtaacttgattgaaaatctcttgtaatagctctctccggctatatgtttgagaaatgacgcaccatgctagaccatcaaagtgagaaacaatgatgtctttattatacacctttctagcaatagttgtcttcccttgtccccccatgcctataattgggatgacatctagctcatttgtaccttgaatcagatattgaattattctttcagcttcattctcaaaacccactatctcctcatcatccgcaagattgctatgttgagatggcatatggttagatggctccaccgcagagctgtgcttaagagcaatgttctccgaccaaatctcgctcacatctgcactaatatacttgatctcttttaagattgtaggaagtgagaaaaaaatatgccaatgagccttatactgagcaagaatagagtcaatggcaacttcagcttcatatgccaaattgatagtacgcctctgaatatctttaagaatttcatgttcatgctgcacctttgcaacatctctgaaaatggatgtcagatttcaacatctcattcaattttctttggagagaatctagaaagctcaatccaccaactgtgggaaactgagatggagtgaattctaatgatatatagtacatctcctccacttttgccttcaaattttcaacttcctctagtatctgtatcaatcgaaaattaatttttctaattctatcttttattgtagaattacaaaaactgtatcaccaacaagagctccaaccttttccaatacctcattcaacctcttaccattaataacatgatttggaacatcaccaaaaaaaatcaacaagaagtctattgccacatcaatatttcgagcagagacattagaatggaagttcttaaacttttgttttctgagacacactagcaaattgtagagatgatgtgaaaatccttttggtaatttcttgtccttgaaatttcttgattgactaaacttttaagccttcagttcacagagaaaaatcttcttcatttccagctcgactagcacaaccaaggataatagataaggaggcataccctcgatatgagtcgtatcatctccatcctcattaagccaaagagcaagacagagctgccccacattgtcagccatgaactgaattcgagtctccagaccttccagcttctcatggtcgacgtaactatttatctccgtggcatataaatatctcaaaaatctcattttcttttgaatgattttcacttgctttaaaaatcgatctgtcttatgaaggattttgattcctttcctcaaaaaagggtcagacttgactagatacctccccgcatcatttagattcttgtcgaggtaatccatatattctgacagataggaatgatccagctcataattggaccctggactggtattatcttccttgaattataacaaatgtgatactagcctttccacattaagattagttttgcattcatccatgttaccatcaaaaactgattgaagcatttccacagtcaattgggccttctttgtaactttgactaaggaatcatgcgaaagaacatgatggtatttgaggaaagttcgaaaaaatcttagctccatttcaagtgtcacaatttgatcaatcttgacactattcagatcacctccactcttgatccttcataggtgatctagcatatcataaatgtcattatgtgccatctgtaggtaaagtagaaaatgcatgttagacgctacgaatattcatcaaactcttggaatattagtttcaatcagagcaacatttttgttcatgtctttcaacatatactgttagaagctacagttcttgctatagaaattttgttactttattgtaaatgttgcttcgactttaggcattgactctaaatgcacaaacctcctattttcacaacaaagaccattaatagtagcaaaatgagaacatgactttcaaattgcaagtgaaacctgttgcggaagccaaatgtatatagtgtgaatgagtcacaactactataccaaaaaaatatggcagccactaaataataaataagacaataaagcaacaataaaagaaacaccagaatttaacgaggttcggccaatttagcctactcctcggacacaaccaatattttatttcactccaaaaatacaagtgaaataatactaaagagagaagatacaaatgccttaaatagataagaaggcaaatgagaggtgtatttaaatcctaaacattaggcctccttttatagggaaaattttcctaccaaaagcttaaactaccgatgtgggagagggattttgacattttcaacaaatctccaccttggcaaaattccacatcttcaattttctctctataacaaattttggttgtatcttcatcttcaatcttcagtgttcaacaatgttgatcaaatccaaacaatgttgaaacttgatcgcagtcaccacttttgttagcatatcagcaggattctccgtagtatgaattttcttcaccgtgactccaccttcttctatgatttctcgtacgaaatgataccgaacatcaatgtgcttcgtccttgcatgataaacttggttcttcgctaattgaatagcactttgactatcacaaaaaattgtgatatccttttgttcaacaccaagctcctttagcaacccttgaagccaaattgtctccttcacagcctctgtaatagccatgtactctgcctctgttgtagacaaagcaactgttgactgcaaagtagacttccaactaactggtgcctttgcaaaagtaaacacataaccagtagttgatcttcgtttgtccagatcacccgcaaaatctgagtcacaatatccaactacagactgattgctttcctgatcaaaaactaacccaacatctacagtattatgaatataccatagaatccacttcacagcttgccaatgctcctttcctggattatgcatatacctgctaataactccaacagcttgtgaaatgtcaggtctcgtacagaccattgcatacatcaagctaccaacaacatttgcgtatggtacctttgacatatactctcgttcagcttcatcctttggcgacatagtagtactcagcttaaaatggggagcaagtggagtactaactggcttagtcttgtcatctatgccaaaacgttgtagtactctcttcaaatattctttctgagataaacagagtttctttgaacgtctatctcttattatctccatgccaagaattttctttgcctcacccagatcattcatctcgaactccttcttcagttgaattttcaacttatcaatttcttctgaattcttggaagctatcaacatatcatcaacatatagaagaagatatataaaggaaccatctttaagcctgcacaaatacacacaatgatcatatttgcttctcttgtacccttgctgcaacataaacttgtcaaatcgcttgtaccattgtctagaagattgtttcaatccgtacaacgatttttcaagtttgcacaccatattttcctttccagcaactttgaatccttccggctgagtcatgtagatttcctcctccaagtttccatgtaaaaacgcagtttttacatccatctgaactagttccaaatccaattgtgctatcaaagccaacataattcgaatggaggaatattttacaactggagaaaacacttcattataatcaattccttttgagcatatcctttggccaccaatcttgctttgtagcgaacatctacttggttaggaaatccctccttctttgcaaatacccatttgcacccaattgctttctttccctttgggagattggccaatctccatgtatgattctgatgaagggactgtatgtcatcattcatggcattcctccacttatcttcttccgaactttggactgcgtctttataagtggtaggaacatcatcagctacaattgcggttgcacaagcaactgtctctatgagacgaacaggttttgttattgtcttttttggcctgctggttgctattgattcaagttgttgttgaggttcctgagttggaatctcctctactggctctccatccagagggtaatcttcatttgtttcctcctctgcttcttgtgtaggaaaaataaattttccctcaaactccacctgcttagaagcaccatcatcttgtttggtatctccacttgttaccttacttaccatagcagattcgtcgaaggtgacatccctgctgaatattactttctttgtcataggacaccataagcgatatcctttgactccagaagtaatccccataaaaatggccttcttgaaattccacgaaccagtacctgttgggacacatatgatagctacaagctgagtccatcaaccatatgtctgatgatgttgatggctctgttgtaactaatgaaaagtctgaatcatcacaatcagctacatttgaatccataatggcctttccattgttatgtttggccttattcttcaacttcggacagtctttcttccagtgccccttttctcgacaaaaggcacattcatctttgctgggtttagatcttgacttagatcttcctttcttcgtcctcgtttgattttgaggacaacccctcacaaacagtgcttctccttctccgcccttctgtttttctcgcttcctttgttcgtagctgtacaaagccgaacaaacttctctgagagaaacttcgtcatttccatggagtagagtagtttcaaggtgctcgtactcatcaggaagtgacgccaacaacatcaaggccaagtcaccatcatcataagttgcatccatattttgcaaatctgtgaccaacttattgaaactggtgatatgtttattcatcgtggtaccaggaacataggtgaagtgaaacagtctcttcttcatgtacaatttattttgactgtttttcttcaaaaatttatcctccagtgctttccataatttacttgcagaattttcctttgtgtatggatatttctgctctctagcaaggtaggatcgaatgagtcacaactactataccaaaaaaatatggcagccactaaataataaataagacaataaagcaacaataaaagaaacaccagaatttaacgaggttcggccaatttagcctactcctcggacacaaccaatattttatttcactctaaaaatacaagtgaaataatactaaagagagaagatacaaatgccttaaatagataagaaggcaaatgagaggtgtatttaaatcctaaacattaggcctccttttatagggaaaatttccctaccaaaagcttaaactaccgatgtgggagagggattttgacattttcaacaaaaccaacttaaagattttgaaaacaagaaaaggaaatggagtttaagtataattaaaatgctaagcaggttccaccaaagggaaaaaagaattcagaggtaaaatgagattgacaaaagtcgtaaaaatgatcagatcaacaaaataaagtatatctttagatccaattacatgcatgaacaaaattttcggatgtaacatgtcgagtgaaattagaaagttcattgaaatatacctgataaagaccaaagtttgcagtaggagaaaacttctaatgataactataactaagaagaaaagattaatatcagcataaaggtcggaaggaagaaagctttatctctttaggaaagattaatatcagcttcaaccaaaatcatgtttaatgtatatggactggaaccaaatgttaccaaaagtcaatggttgcagtattttattagtaacaggggctatcatattataatacagatagagagctaattggcaggttataatccattctcattggcctcaaaagtcaatagttacatctgttaatgaataacattgcttagtatattattattagttaatatacaagtcagtcgcttataacgcgatgatcatgcaagccactcctagcaattgcagtagtttcctattattctgtctgtgagatgctgatgatgagatacttcttgctagaagaatatttcagtagtattcagtcgactactatattaaactcgaaatgtagaggctggatattgtatcgttcaaccaacatttattcagaatgggctaatagaacttcttccaagataaaggaagacttagagatatgcgtcatcagccgtca
